(12) United States Patent
Schütz et al.

(10) Patent No.: US 11,414,706 B2
(45) Date of Patent: Aug. 16, 2022

(54) METHOD OF DETERMINING A NUMERIC INDEX OF TUMOR-ASSOCIATED COPY NUMBER CHANGES OF CIRCULATING NUCLEIC ACIDS ASSOCIATED WITH PROSTATE CANCER

(71) Applicant: Chronix Biomedical, San Jose, CA (US)

(72) Inventors: Ekkehard Schütz, Göttingen (DE); Julia Beck, Gottingen (DE); Howard Urnovitz, San Jose, CA (US)

(73) Assignee: Chronix Biomedical, San Jose, CA (US)

( * ) Notice: Subject to any disclaimer, the term of this patent is extended or adjusted under 35 U.S.C. 154(b) by 777 days.

(21) Appl. No.: 15/985,649

(22) Filed: May 21, 2018

(65) Prior Publication Data

US 2018/0340233 A1    Nov. 29, 2018

Related U.S. Application Data

(63) Continuation of application No. 15/727,504, filed on Oct. 6, 2017, now abandoned, which is a continuation of application No. 14/799,989, filed on Jul. 15, 2015, now abandoned, which is a continuation of application No. 13/701,568, filed as application No. PCT/US2011/038780 on Jun. 1, 2011, now abandoned.

(60) Provisional application No. 61/351,708, filed on Jun. 4, 2010.

(51) Int. Cl.
*C12Q 1/6886* (2018.01)

(52) U.S. Cl.
CPC ..... *C12Q 1/6886* (2013.01); *C12Q 2600/158* (2013.01)

(58) Field of Classification Search
None
See application file for complete search history.

(56) References Cited

U.S. PATENT DOCUMENTS

| | | |
|---|---|---|
| 2008/0318243 A1 | 12/2008 | Haga |
| 2009/0162836 A1 | 6/2009 | Widschwendter |
| 2009/0280479 A1 | 11/2009 | Hoon et al. |

FOREIGN PATENT DOCUMENTS

| | | |
|---|---|---|
| WO | 2009/051842 A2 | 4/2009 |
| WO | 2010/053980 A2 | 5/2010 |

OTHER PUBLICATIONS

The International Search Report from PCT/US2011/038780, dated Aug. 13, 2012, 9 pages.
Allen et al. "Role of cell-free plasma DNA as a diagnostic marker for prostate cancer", *Ann. N.Y. Acad. Sci.* 1022(1): 76-80 (2004).
Bastian et al., "Prognostic value of preoperative serum cell-0free circulating DNA in men with prostate cancer undergoing radical prostatectomy", *Clinical Cancer Research* 13(18):5361-5367 (2007).
Ellinger et al.; "Noncancerous PTSG2 Dna fragments of apoptotic origin in sera of prostate cancer patients qualify as diagnostic and prognostic indicators"; *Int. J. Cancer*; 122:138-143 (Aug. 2007).
Felix et al., "Circulating tumour-associated plasma DNA represents an independent and informative predictor of prostate cancer", *BJU Intl.* 98(3): 544-548 (2006).
Müller et al.; "Comparison of genetic alterations detected in circulating microsatellite DNA in blood plasma samples of patients with prostate cancer and benign prostatic hyperplasia"; *Ann. N.Y. Acad. Sci.*; 1075:222-229 (2006).
Salani et al.; "Measurement of cyclin E genomic copy number and strand length in cell-free DNA distinguish malignant versus benign effusions"; *Clin. Cancer Res.*; 13(19):5805-5809 (Oct. 2007).
Sunami et al.; "Multimarker circulating DNA assay for assessing blood of prostate cancer patients"; *Clin. Chem.*; 55(3):559-567 (2009).
Umetani et al.; "Increased integrity of free circulating DNA in sera of patients with colorectal or periampullary cancer: direct quantitative PCR for ALU repeats"; *Clin. Chem.*; 52(6):1062-1069 (2006).
The Supplementary European Search Report, from EP Application No. 11790345, dated Oct. 15, 2013, 16 pages.
GenBankAccession No. AL356498 (version AL356498.10). "Human DNA Sequence from Clone RP11-341G2 on chromosome 9 contains a ubiquitin pseudogene and a DiGeorge syndrome-related protein pseudogene, complete sequence." Jan. 13, 2009, 28 pages.
GenBankAccession No. AL356285 (version AL356285.9). "Human DNA sequence from clone RP11-569O4 on chromosome 13 contains the 5' end of the XPO4 gene for likely ortholog of mouse exportin 4, a CCR4-NOT transcription complex, subunit 4 (CNOT4) (NOT4, NOT4H, CLONE243) pseudogene, a heterogenous nuclear ribonucleo protein A1 (HNRPA1)(HNRNPA1) pseudogene, a pseudogene similar to part of peptidoprolylisomerase A (cyclophilin A) (PPIA), a Laminin receptor 1 (67kD, ribosomal protein SA)(LAMR1)(LRP, p40, RPSA, 37LRP, LAMBR) pseudogene, the ' end ofthe LATS2 gene for LATS, large tumor suppressor, homolog 2 (LATS (large tumor suppressor, *Drosophila*) homolog2), two novel genesand 3 CpG islands, complete sequence." Jan. 13, 2009, 46 pages.

(Continued)

Primary Examiner — G Steven Vanni

(74) Attorney, Agent, or Firm — Kilpatrick Townsend & Stockton LLP

(57) ABSTRACT

The invention provides methods and reagents for diagnosing prostate cancer that are based on the detection of biomarkers in the circulating nucleic acids from a patient to be evaluated.

3 Claims, 1 Drawing Sheet
Specification includes a Sequence Listing.

(56) References Cited

OTHER PUBLICATIONS

Papadopoulou et al., "Cell-free DNA and RNA in plasma as a new molecular marker for prostate and breast cancer", *Ann. N.Y. Acad. Sci.* 10 75: (2006), 235-243.
Schwarzenbach et al., "Cell-free tumorDNA in blood plasmaasa marker for circulating tumor cells in prostate cancer", *Clin. Cancer Res.* 15(3): (2009) 1032-1038.

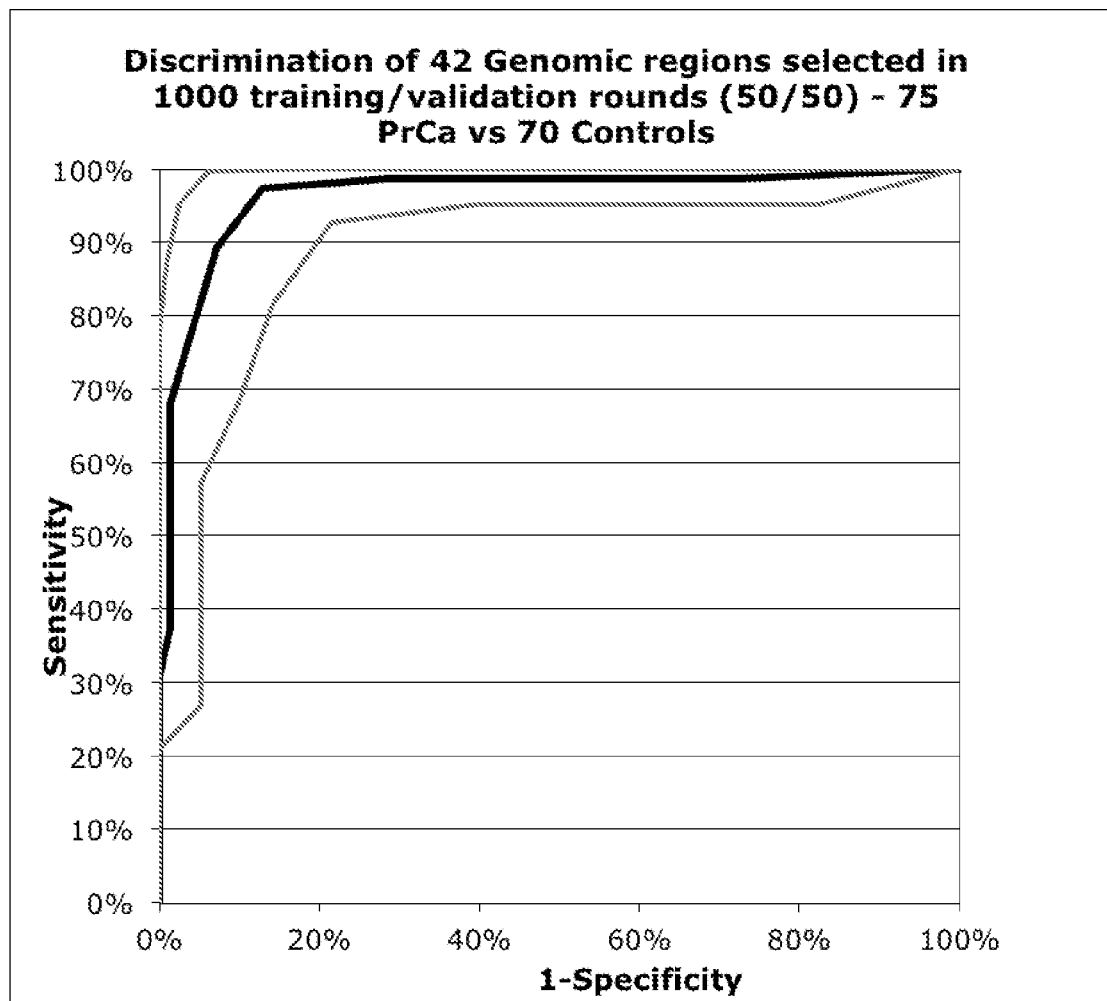

METHOD OF DETERMINING A NUMERIC INDEX OF TUMOR-ASSOCIATED COPY NUMBER CHANGES OF CIRCULATING NUCLEIC ACIDS ASSOCIATED WITH PROSTATE CANCER

CROSS-REFERENCE TO RELATED APPLICATIONS

This application is a continuation of U.S. application Ser. No. 15/727,504, filed Oct. 6, 2017, which is a continuation of U.S. application Ser. No. 14/799,989, filed Jul. 15, 2015, which claims priority to U.S. application Ser. No. 13/701,568, filed Feb. 19, 2013; which is a U.S. National Phase of PCT/US2011/038780, filed Jun. 1, 2011; which claims benefit of U.S. provisional application No. 61/351,708, filed Jun. 4, 2010. Each application is herein incorporated by reference.

REFERENCE TO SEQUENCE LISTING

This application includes a Sequence Listing as a text file named SEQ_083443-1090036-001340US.TXT created Jul. 30, 2018 and containing 1,480,314 bytes. The material contained in this text file is incorporated by reference in its entirety for all purposes.

BACKGROUND OF THE INVENTION

Methods to detect prostate cancer, including PSA tests, are extremely unreliable (see, e.g., Wever et al., *J Natl Cancer Inst* 2010;102:352-355, 2010; Schröder et al., *N. Engl. J. Med* 360:1320-1328, 2009). There is a need for effective detection methods. This invention addresses that need.

BRIEF SUMMARY OF THE INVENTION

The invention is based, in part, on the discovery of circulating nucleic acids (CNA) biomarkers associated with prostate cancer. In some embodiments, the CNA biomarkers are nucleic acid sequences, in the current invention DNA sequences, that are present in the blood, e.g., in a serum or plasma sample, of a prostate cancer patient, but are rarely present, if at all, in the blood, e.g., a serum or plasma sample, obtained from a normal individual, i.e., in the context of this invention, an individual that does not have prostate cancer. In some embodiments, the CNA biomarkers are nucleic acid sequences, in the current invention DNA sequences, i.e., DNA fragments, that are present in the blood, e.g., in a serum or plasma sample, of a normal individual, but are rarely present, if at all, in the blood, e.g., a serum or plasma sample, obtained from a prostate cancer patient.

Accordingly, in one aspect, the invention provides a method of analyzing CNA in a sample (blood, serum or plasma) from a patient comprising detecting the presence of at least one cell-free DNA having a nucleotide sequence falling within a chromosomal region set forth in Tables 2-5 (or having a nucleotide sequence that is part of one of the sequences set forth in Tables A-D) in the sample. In some embodiments, detecting the presence of, or the amount of, the at least one biomarker comprises detecting a cell-free DNA molecule having between 50 and 400 consecutive nucleotides of a unique sequence within a chromosomal region as set forth in Tables 2-5 (or of a unique sequence set forth in Tables A-D).

In one embodiment, a method of analyzing circulating free DNA in a patient sample is provided, comprising determining, in a sample that is blood, serum or plasma, the presence or absence, or the amount of, at least 2, 3, 4, 5, 7, 8, 9, 10, 15, 20, 30, 40, or at least 50 cell-free DNA molecules each having a sequence falling within a different chromosomal region set forth in Table 2, 3, 4, or 5, and preferably the sequences of the cell-free DNA molecules are free of repetitive element. In preferred embodiments, the cell-free DNA molecules have sequences falling within different chromosomal regions in the same table selected from Tables 2-5.

In another aspect, the present invention provides a kit including two or more (e.g., at least 2, 3, 4, 5, 6, 7, 8, 9, 10, 12, 15, 20, 25, 30, 40, or at least 50, but less than 115) sets of oligonucleotides. Each set comprises one or more oligonucleotides with a nucleotide sequence falling within one single chromosomal region that is set forth in Tables 2-5. Preferably, different oligonucleotide sets correspond to different chromosomal regions within the same table selected from Tables 2-5. Also, preferably the oligonucleotides are free of repetitive element. Optionally, the oligonucleotides are attached to one or more solid substrates such as microchips and beads.

In another aspect, the present invention provides a method of diagnosing or screening for prostate cancer in a patient. The method includes the steps of: (a) determining, in a sample that is blood, serum or plasma from a patient, the presence or absence or the amount of, at least 2, 3, 4, 5, 7, 8, 9, 10, 15, 20, 30, 40, or at least 50 cell-free DNA molecules each having a sequence falling within a different chromosomal region set forth in Table 2, 3, or 4; and (b) correlating the presence of, or an increased amount of, said first and second cell-free DNAs with an increased likelihood that the patient has prostate cancer. Preferably, the sequences of the cell-free DNA molecules are free of repetitive element. In preferred embodiments, the cell-free DNA molecules have sequences falling within different chromosomal regions in the same table chosen from Tables 2-4.

In one aspect, the invention provides a method of identifying a patient that has a CNA biomarker associated with prostate cancer, the method comprising detecting the presence of at least one biomarker set forth in Table 2, Table 3, or Table 4 in a CNA sample obtained from serum or plasma from the patient. A biomarker can be identified using any number of methods, including sequencing of CNA as well as use of a probe or probe set to detect the presence of the biomarker.

In some embodiments, the invention provides a method of identifying a patient that has a CNA biomarker that is associated with the absence of prostate cancer, the method comprising detecting the presence of at least one biomarker set forth in Table 5 in a CNA sample from serum or plasma from the patient. A biomarker can be identified using any number of methods, including sequencing of CNA as well as use of a probe or probe set to detect the presence of the biomarker.

In a further aspect, the invention provides a kit for identifying a patient that has a biomarker for prostate cancer and/or that has a biomarker associated with a normal individual that does not have prostate cancer, wherein the kit comprises at least one polynucleotide probe to a biomarker set forth in Table 2, 3, 4, or 5. Preferably, such a kit comprises probes to multiple biomarkers, e.g., at least 2, 3, 4, 5, 10, 20, 30, 40, 50, or more, of the biomarkers set forth in Tables 2-5. In some embodiments, the kit also includes an electronic device or computer software to compare the hybridization patterns of the CNA in the patient sample to a prostate cancer data set comprising a listing of biomarkers that are present in prostate cancer patient CNA, but not CNA samples from normal individuals.

In some embodiments, the presence of the at least one biomarker in CNA is determined by sequencing. In some embodiments, the presence of the at least one biomarker in CNA is determined using an array. In some embodiments, the presence of the at least one biomarker in CNA is determined using an assay that comprises an amplification reaction, such as a polymerase chain reaction (PCR). In some embodiments, a nucleic acid array forming a probe set comprising probes to two or more chromosomal regions set forth in Tables 2-5 is employed. In some embodiments, a nucleic acid array forming a probe set comprising 2, 3, 4, 5, 6, 7, 8, 9, 10 or more chromosomal regions, or all of the chromosomal regions, set forth in Table 2 is employed. In some embodiments, a nucleic acid array forming a probe set comprising 2, 3, 4, 5, 6, 7, 8, 9, 10, or more chromosomal regions, or all of the chromosomal regions, set forth in Table 3 is employed. In some embodiments, a nucleic acid array forming a probe set comprising 2, 3, 4, 5, 6, 7, 8, 9, 10 or more chromosomal regions, or all of the chromosomal regions, set forth in Table 4 is employed. In some embodiments, a nucleic acid array forming a probe set comprising two or more chromosomal regions, or all of the chromosomal regions set forth in Table 5 is employed.

In an additional aspect, the invention provides a method of detecting prostate cancer in a patient that has, or is suspected of having, prostate cancer, the method comprising contacting DNA from the serum or plasma sample with a probe that selectively hybridizes to a sequence present on a chromosomal region described herein, e.g., a sequence set forth in Tables A-D under conditions in which the probe selectively hybridizes to the sequence; and detecting the presence or absence of hybridization of the probe, wherein the presence of hybridization to a sequence set forth in Table A, B, or C is indicative of prostate cancer.

The Tables of Sequences A, B, C, and D provide examples of sequences corresponding to the chromosome regions set forth in Table 2, Table 3, Table 4, and Table 5, respectively. The designation (N)x in Tables A-D refer to repetitive element sequences. Table A contains SEQ ID NOS:1-1072. Table B contains SEQ ID NOS:1073-1916. Table C contains SEQ ID NOS:1917-1968. Table D contains SEQ ID NOS: 1969-1972.

BRIEF DESCRIPTION OF THE DRAWINGS

FIG. 1 provides an example of a ROC curve using the 42 highest ranking regions of the chromosomal regions identified in Tables 4 and 5, collectively. The actual ROC curve-build from score sums is given together with the 95% confidence limits.

DETAILED DESCRIPTION OF THE INVENTION

As used herein, a "biomarker" as used herein refers to a nucleic acid sequence that corresponds to a chromosomal region, where the presence of the nucleic acid in CNA is associated with prostate cancer.

In the current invention, a "chromosomal region" listed in any one of Tables 1 to 5 refers to the region of the chromosome that corresponds to the nucleotide positions indicated in the tables. The nucleotide positions on the chromosomes are numbered according to *Homo sapiens* (human) genome, build 37.1 as of June 2010 (Tables 1-3) and *Homo sapiens* (human) genome, build 36 as of March 2006 (Table 4, 5). As understood in the art, there are naturally occurring polymorphisms in the genome of individuals. Thus, each chromosome region listed in the tables encompasses allelic variants as well as the particular sequence in the database, e.g., the sequences in Tables A-D corresponds to the chromosomal regions noted. An allelic variant typically has at least 95% identity, often at least 96%, at least 97%, at least 98%, or at least 99% identity to the sequence of a chromosomal region noted in the Tables that is present in a particular database, e.g., the National Center for Biotechnology Information (*Homo sapiens* Build 37.1 at the ncbi nlm nih mapview website.) Percent identity can be determined using well known algorithms, including the BLAST algorithm, e.g., set to the default parameters. Further, it is understood that the nucleotide sequences of the chromosomes may be improved upon as errors in the current database are discovered and corrected. The term "chromosomal region" encompasses any variant or corrected version of the same region as defined in Tables 1-5. Given the information provided in the tables in the present disclosure, especially in view of the sequences listed in Tables A-D, a skilled person in the art will be able to understand the chromosomal regions used for the present invention even after new variants are discovered or errors are corrected.

"Detecting the presence of a chromosomal region" in CNA in the context of this invention refers to detecting any sequence from a chromosomal region shown in Table 2, 3, 4, or 5, where the sequence detected can be assigned unambiguously to that chromosomal region. Thus, this term refers to the detection of unique sequences from the chromosomal regions. Methods of removing repetitive sequences from the analysis are known in the art and include use of blocking DNA, e.g., when the target nucleic acids are identified by hybridization. In some embodiments, typically where the presence of a prostate cancer biomarker is determined by sequencing the CNA from a patient, well known computer programs and manipulations can be used to remove repetitive sequences from the analysis (see, e.g., the EXAMPLES section). In addition, sequences that have multiple equally fitting alignment to the reference database are typically omitted from further analyses.

The term "detecting a biomarker" as used herein refers to detecting a sequence from a chromosomal region listed in Table 2, Table 3, Table 4, or Table 5. A biomarker is considered to be present if any nucleic acid sequence present in the CNA is unambiguously assigned to the chromosomal region.

The term "unambiguously assigned" in the context of this invention refers to determining that a DNA detected in the CNA of a patient is from a particular chromosomal region. Thus, in detection methods that employ hybridization, the probe hybridizes specifically to that region. In detection methods that employ amplification, the primer(s) hybridizes specifically to that region. In detection methods that employ sequencing, the sequence is assigned to that region based on well-known algorithms for identity, such as the BLAST algorithm using high stringent parameters, such as e<0.0001. In addition, such a sequence does not have a further equally fitting hit on the used database.

The term "circulating nucleic acids" refers to acellular nucleic acids that are present in the blood.

The term "circulating cell-free DNA" as used herein means free DNA molecules of 25 nucleotides or longer that are not contained within any intact cells in human blood, and can be obtained from human serum or plasma.

The term "hybridization" refers to the formation of a duplex structure by two single stranded nucleic acids due to complementary base pairing. Hybridization can occur between exactly complementary nucleic acid strands or between nucleic acid strands that contain minor regions of mismatch. As used herein, the term "substantially complementary" refers to sequences that are complementary except for minor regions of mismatch. Typically, the total number of mismatched nucleotides over a hybridizing region is not more than 3 nucleotides for sequences about 15 nucleotides in length. Conditions under which only exactly complementary nucleic acid strands will hybridize are referred to as "stringent" or "sequence-specific" hybridization conditions. Stable duplexes of substantially complementary nucleic acids can be achieved under less stringent hybridization conditions. Those skilled in the art of nucleic acid technology can determine duplex stability empirically considering a number of variables including, for example, the length and base pair concentration of the oligonucleotides, ionic strength, and incidence of mismatched base pairs. For example, computer software for calculating duplex stability is commercially available from National Biosciences, Inc. (Plymouth, Minn.); e.g., OLIGO version 5, or from DNA Software (Ann Arbor, Mich.), e.g., Visual OMP 6.

Stringent, sequence-specific hybridization conditions, under which an oligonucleotide will hybridize only to the target sequence, are well known in the art (see, e.g., the general references provided in the section on detecting polymorphisms in nucleic acid sequences). Stringent conditions are sequence-dependent and will be different in different circumstances. Generally, stringent conditions are selected to be about 5° C. lower to 5° C. higher than the thermal melting point (Tm) for the specific sequence at a defined ionic strength and pH. The Tm is the temperature (under defined ionic strength and pH) at which 50% of the duplex strands have dissociated. Relaxing the stringency of the hybridizing conditions will allow sequence mismatches to be tolerated; the degree of mismatch tolerated can be controlled by suitable adjustment of the hybridization conditions.

The term "primer" refers to an oligonucleotide that acts as a point of initiation of DNA synthesis under conditions in which synthesis of a primer extension product complementary to a nucleic acid strand is induced, i.e., in the presence of four different nucleoside triphosphates and an agent for polymerization (i.e., DNA polymerase or reverse transcriptase) in an appropriate buffer and at a suitable temperature. A primer is preferably a single-stranded oligodeoxyribonucleotide. The primer includes a "hybridizing region" exactly or substantially complementary to the target sequence, preferably about 15 to about 35 nucleotides in length. A primer oligonucleotide can either consist entirely of the hybridizing region or can contain additional features which allow for the detection, immobilization, or manipulation of the amplified product, but which do not alter the ability of the primer to serve as a starting reagent for DNA synthesis. For example, a nucleic acid sequence tail can be included at the 5' end of the primer that hybridizes to a capture oligonucleotide.

The term "probe" refers to an oligonucleotide that selectively hybridizes to a target nucleic acid under suitable conditions. A probe for detection of the biomarker sequences described herein can be any length, e.g., from 15-500 bp in length. Typically, in probe-based assays, hybridization probes that are less than 50 bp are preferred.

The term "target sequence" or "target region" refers to a region of a nucleic acid that is to be analyzed and comprises the sequence of interest.

As used herein, the terms "nucleic acid," "polynucleotide" and "oligonucleotide" refer to primers, probes, and oligomer fragments. The terms are not limited by length and are generic to linear polymers of polydeoxyribonucleotides (containing 2-deoxy-D-ribose), polyribonucleotides (containing D-ribose), and any other N-glycoside of a purine or pyrimidine base, or modified purine or pyrimidine bases. These terms include double- and single-stranded DNA, as well as double- and single-stranded RNA. Oligonucleotides for use in the invention may be used as primers and/or probes.

A nucleic acid, polynucleotide or oligonucleotide can comprise phosphodiester linkages or modified linkages including, but not limited to phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages.

A nucleic acid, polynucleotide or oligonucleotide can comprise the five biologically occurring bases (adenine, guanine, thymine, cytosine and uracil) and/or bases other than the five biologically occurring bases. These bases may serve a number of purposes, e.g., to stabilize or destabilize hybridization; to promote or inhibit probe degradation; or as attachment points for detectable moieties or quencher moieties. For example, a polynucleotide of the invention can contain one or more modified, non-standard, or derivatized base moieties, including, but not limited to, N6-methyladenine, N6-tert-butyl-benzyl-adenine, imidazole, substituted imidazoles, 5-fluorouracil, 5 bromouracil, 5-chlorouracil, 5-iodouracil, hypoxanthine, xanthine, 4-acetylcytosine, 5 (carboxyhydroxymethyl)uracil, 5 carboxymethylaminomethyl-2-thiouridine, 5 carboxymethylaminomethyluracil, dihydrouracil, beta-D-galactosylqueosine, inosine, N6 isopentenyladenine, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaminomethyluracil, 5-methoxyaminomethyl-2-thiouracil, beta-D mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2 thiocytosine, 5-methyl-2-thiouracil, 2-thiouracil, 4-thiouracil, 5-methyluracil, uracil-5-oxyacetic acidmethylester, 3-(3-amino-3-N-2-carboxypropyl) uracil, (acp3)w, 2,6-diaminopurine, and 5-propynyl pyrimidine. Other examples of modified, non-standard, or derivatized base moieties may be found in U.S. Pat. Nos. 6,001,611; 5,955, 589; 5,844,106; 5,789,562; 5,750,343; 5,728,525; and 5,679,785, each of which is incorporated herein by reference in its entirety. Furthermore, a nucleic acid, polynucleotide or oligonucleotide can comprise one or more modified sugar moieties including, but not limited to, arabinose, 2-fluoroarabinose, xylulose, and a hexose.

The term "repetitive element" as used herein refers to a stretch of DNA sequence of at least 25 nucleotides in length that is present in the human genome in at least 50 copies.

The terms "arrays," "microarrays," and "DNA chips" are used herein interchangeably to refer to an array of distinct polynucleotides affixed to a substrate, such as glass, plastic, paper, nylon or other type of membrane, filter, chip, bead, or any other suitable solid support. The polynucleotides can be synthesized directly on the substrate, or synthesized separate from the substrate and then affixed to the substrate. The arrays are prepared using known methods.

Introduction

The invention is based, at least in part, on the identification CNA sequences from particular chromosomal regions that are present or at an increased amount in the blood of patients that have prostate cancer, but are rarely, if ever, present, or at a lower amount, in the blood of normal patients that do not have prostate cancer. The invention is also based, in part, on the identification of biomarkers in the CNA in normal individuals, i.e., in the context of this invention, individuals not diagnosed with prostate cancer, that are rarely, if ever, present in patients with prostate cancer. Thus, the invention provides methods and devices for analyzing for the presence of sequences from a chromosomal region corresponding to at least one of the chromosomal regions set forth in Table 2, Table, 3, Table 4, or Table 5.

Accordingly, in one aspect, the invention provides a method of analyzing CNA in a sample (blood, serum or plasma) from a patient comprising detecting the presence of, or an amount of, at least one circulating cell-free DNA having a nucleotide sequence of at least 25 nucleotides falling within a chromosomal region set forth in Table 2, 3, 4, o5 (or having a nucleotide sequence that is a part of one of the sequences set forth in Table A, B, C, or D). Preferably, the circulating cell-free DNA is free of repetitive element. In one embodiment, the patient is an individual suspected of or diagnosed with cancer, e.g., prostate cancer.

By "falling within" it is meant herein that the nucleotide sequence of a circulating cell-free DNA is substantially identical (e.g., greater than 95% identical) to a part of the nucleotide sequence of a chromosome region. In other words, the circulating cell-free DNA can hybridize to under stringent conditions, or be derived from, the chromosomal region.

In one embodiment, a method of analyzing circulating cell-free DNA in a patient sample is provided, comprising determining, in a sample that is blood, serum or plasma, the presence or the amount of, a plurality of circulating cell-free DNA molecules each having a sequence of at least 25 nucleotides in length falling within the same one single chromosomal region set forth in Table 2, Table 3, Table 4, or Table 5 (or each having a nucleotide sequence of at least 25 consecutive nucleotides in length that is a part of the same sequence set forth in Table A, Table B, Table C, or Table D). There may be two or more or any number of different circulating cell-free DNA molecules that are all derived from the same one chromosomal region set forth in Table 2, 3, 4, or 5, and in some embodiments, all such circulating cell-free DNA molecules are detected and/or the amounts thereof are determined.

Preferably the sequences of the circulating cell-free DNA molecules are free of repetitive elements.

In one embodiment, a method of analyzing circulating cell-free DNA in a patient sample is provided, comprising determining, in a sample that is blood, serum or plasma, the presence or absence or the amount of, at least 2, 3, 4, 5, 7, 8, 9, 10, 15, 20, 30, 40, or at least 50 circulating cell-free DNA molecules each having a sequence of at least 25 base pairs falling within a different chromosomal region set forth in Table 2, Table 3, Table 4, or Table 5 (or having a nucleotide sequence of at least 25, 40, 50, 60, 75 or 100 consecutive nucleotides in length that is a part of one of the sequences set forth in Table A, Table B, Table C, or Table D). Preferably the sequences of the circulating cell-free DNA molecules are free of repetitive elements. In preferred embodiments, the cell free DNA molecules have sequences falling within different chromosomal regions in the same table that is chosen from Tables 2-5. In one specific embodiment, the presence or absence or the amounts of, at least 2, 3, 4, 5, 7, 8, 9, 10, 15, 20, or at least 25, or of 30, 31, or 32, circulating cell-free DNA molecules are determined, the sequence of each falling within a different chromosomal region set forth in Table 2 (or having a nucleotide sequence of at least 25, 40, 50, 60, 75 or 100 consecutive nucleotides in length that is a part of one of the sequences set forth in Table A). In another specific embodiment, the presence or absence or the amounts of, at least 2, 3, 4, 5, 7, 8, 9, 10, or at least 15, or of 20, 21, or 22, circulating cell-free DNA molecules are determined, the sequence of each falling within a different chromosomal region set forth in Table 3 (or having a nucleotide sequence of at least 25, 40, 50, 60, 75 or 100 consecutive nucleotides in length that is a part of one of the sequences set forth in Table B). In one specific embodiment, the presence or absence or the amounts of, at least 2, 3, 4, 5, 7, 8, 9, 10, 15, 20, 25, 30, 35, 50, 45, or 50, or of 52, circulating cell-free DNA molecules are determined, the sequence of each falling within a different chromosomal region set forth in Table 4 (or having a nucleotide sequence of at least 25, 40, 50, 60, 75 or 100 consecutive nucleotides in length that is a part of one of the sequences set forth in Table C). In yet another specific embodiment, the presence or absence or the amounts of, at 1, 2, 3, or 4 circulating cell-free DNA molecules are determined each having a sequence falling within a different chromosomal region set forth in Table 5 (or having a nucleotide sequence of at least 25, 40, 50, 60, 75 or 100 consecutive nucleotides in length that is a part of one of the sequences set forth in Table D).

In a specific embodiment, the method of analyzing circulating cell-free DNA includes the steps of: isolating, from blood, serum or plasma sample of a patient, substantially all circulating cell-free DNA molecules having a length of at least 20, 25, 30, 40, 50, 75 or 100 consecutive nucleotides in length, or between 50 and 400 nucleotides in length, obtaining the sequence of each of the circulating cell-free DNA molecules, and comparing the sequence to one or more of the sequences set forth in Tables A-D to determine whether the sequence falls within a chromosomal region set forth in Table 2, 3, 4, or 5.

In another specific embodiment, the method of analyzing circulating cell-free DNA includes the steps of: isolating, from blood, serum or plasma sample of a patient, substantially all circulating cell-free DNA molecules having a length of at least 20, 25, 30, 40, 50, 75 or 100 consecutive nucleotides in length, or between 50 and 400 nucleotides in length, and contacting the circulating cell-free DNA molecules to a plurality of oligonucleotides (e.g., on a DNA chip or microarray) to determine if one of the circulating cell-free DNA molecules hybridizes to any one of the plurality of oligonucleotide probes under stringent conditions. Each of the oligonucleotide probes has a nucleotide sequence identical to a part of the sequence of a chromosomal region chosen from Tables 2-5 (or a sequence set forth in Tables A-D). Thus, if a circulating DNA molecule hybridizes under stringent conditions to one of the oligonucleotide probes, it indicates that the circulating DNA molecule has a nucleotide sequence falling within a chromosomal region set forth in Table 2, Table 3, Table 4, or Table 5.

In the above various embodiments, preferably the circulating cell-free DNA molecules have at least 25 consecutive nucleotides in length (preferably at least 50, 70, 80, 100, 120 or 200 consecutive nucleotides in length). More preferably, the circulating cell-free DNA molecules have between about 50 and about 300 or 400, preferably from about 75 and about 300 or 400, more preferably from about 100 to about 200 consecutive nucleotides of a unique sequence within a chromosomal region as set forth in Table 2, Table 3, Table 4, or Table 5 (or of a unique sequence set forth in Table A, Table B, Table C, or Table D).

In another aspect, the present invention provides a method of diagnosing or screening for prostate cancer in a patient. The method includes the steps of: (a) determining, in a sample that is blood, serum or plasma from a patient, the presence or absence or the amount of, at least 1, 2, 3, 4, 5, 7, 8, 9, 10, 15, 20, 30, 40, or at least 50 circulating cell-free DNA molecules each having a sequence of at least 25 nucleotides in length falling within a different chromosomal region set forth in Table 2, Table 3, or Table 4 (or having a nucleotide sequence of at least 25 consecutive nucleotides in length that is a part of one of the sequences set forth in Table A, Table B, or Table C); and (b) correlating the presence of or an increased amount of the circulating cell-free DNAs with an increased likelihood that the patient has prostate cancer.

Alternatively, the method of invention includes the steps of: (a) determining, in a sample that is blood, serum or plasma from a patient, the presence or absence or the amount of 1, 2, 3, or 4 circulating cell-free DNA molecules each having a sequence of at least 25 nucleotides in length falling within a different chromosomal region set forth in Table 5 (or having a nucleotide sequence of at least 25 consecutive nucleotides in length that is a part of one of the sequences set forth in Table D); and (b) correlating the presence of or an increased amount of the circulating cell-free DNAs with a decreased likelihood that the patient has prostate cancer.

When the steps of the above methods are applied to a patient diagnosed of cancer, the patient may be monitored for the status of prostate cancer, or for determining the treatment effect of a particular treatment regimen, or detecting cancer recurrence or relapse.

In the diagnosis/monitoring method of the present invention, preferably the sequences of the circulating cell-free DNA molecules are free of repetitive elements. In preferred embodiments, the cell free DNA molecules have sequences falling within different chromosomal regions in the same table chosen from Tables 2-5.

In one embodiment, a method of diagnosing prostate cancer in an individual is provided, comprising (a) determining the presence or absence or the amounts of, at least 2, 3, 4, 5, 7, 8, 9, 10, 15, 20, or at least 25, or of 30, 31, or 32, circulating cell-free DNA molecules the sequence of each falling within a different chromosomal region set forth in Table 2 (or having a nucleotide sequence of at least 25 consecutive nucleotides in length that is a part of one of the sequences set forth in Table A); and (b) correlating the presence of or an increased amount of, one or more of the circulating cell-free DNA molecules with an increased likelihood that the individual has prostate cancer or a recurrence of prostate cancer or a failure of treatment for prostate cancer.

In another embodiment, a method of diagnosing prostate cancer in an individual is provided, comprising (a) determining the presence or absence or the amounts of, at least 2, 3, 4, 5, 7, 8, 9, 10, or at least 15, or of 20, 21, or 22, circulating cell-free DNA molecules the sequence of each falling within a different chromosomal region set forth in Table 3 (or having a nucleotide sequence of at least 25 consecutive nucleotides in length that is a part of one of the sequences set forth in Table B); and (b) correlating the presence of, or an increased amount of, one or more of the circulating cell-free DNA molecules with an increased likelihood that the individual has prostate cancer or a recurrence of prostate cancer or a failure of treatment for prostate cancer.

In one embodiment, a method of diagnosing prostate cancer in an individual is provided, comprising (a) determining the presence or absence or the amounts of, at least 2, 3, 4, 5, 7, 8, 9, 10, 15, 20, 25, 30, 35, 40, 45, or 50, or of 52, circulating cell-free DNA molecules the sequence of each falling within a different chromosomal region set forth in Table 4 (or having a nucleotide sequence of at least 25 consecutive nucleotides in length that is a part of one of the sequences set forth in Table C); and (b) correlating the presence of or an increased amount of, one or more of the circulating cell-free DNA molecules with an increased likelihood that the individual has prostate cancer or a recurrence of prostate cancer or a failure of treatment for prostate cancer.

In one embodiment, a method of diagnosing/monitoring prostate cancer in an individual is provided, comprising (a) determining the presence or absence or the amounts of, 1, 2, 3, or 4 circulating cell-free DNA molecules the sequence of each falling within a different chromosomal region set forth in Table 5 (or having a nucleotide sequence of at least 25 consecutive nucleotides in length that is a part of one of the sequences set forth in Table D); and (b) correlating the presence of or an increased amount of, one or more of the circulating cell-free DNA molecules with an increased likelihood that the individual does not have prostatet cancer or a recurrence of prostate cancer or a failure of treatment for prostate cancer.

In yet another embodiment, the method of diagnosing, monitoring or screening for prostate cancer in a patient, includes determining, in a sample that is blood, serum or plasma from the patient, the presence or absence or the total amount of, each and all circulating cell-free DNAs each having a sequence falling within the same one single chromosomal region set forth in Table 2, Table 3, or Table 4; and correlating the presence of one of said circulating cell-free DNAs or an increased total amount of said circulating cell-free DNAs, with an increased likelihood that said patient has prostate cancer, or recurrence of prostate cancer. In other words, there can be any number of, and typically many, different circulating cell-free DNA molecules derived from one single same chromosomal region set forth in Table 2, Table 3, or Table 4, and all of such different circulating cell-free DNA molecules are detected and/or the amount each or all is determined, and correlation with the status of prostate cancer is made.

In a specific embodiment, substantially all circulating cell-free DNA molecules having a length of at least 20, 25, 30, 40, 50, 75 or 100 consecutive nucleotides in length, or between 50 and 400 nucleotides in length, are isolated from a blood, serum or plasma sample of a patient. The sequence of each of the circulating cell-free DNA molecules is determined, and compared with one or more of the sequences set forth in Tables A-D to determine whether the sequence of a circulating cell-free DNA falls within a chromosomal region set forth in Table 2, Table 3, or Table 4. If so, a diagnosis of prostate cancer is made. In the case of a patient treated with a therapy for prostate cancer, recurrence is indicated if a circulating cell-free DNA falls within a chromosomal region set forth in Table 2, Table 3, or Table 4 is detected. In preferred embodiments, a diagnosis of prostate cancer or prostate cancer treatment failure or recurrence is indicated if two or more circulating cell-free DNA molecules fall within 2, 3, 4 or more chromosomal regions set forth in Tables 2-4, preferably all such chromosomal regions being in the same table.

In another specific embodiment, substantially all circulating cell-free DNA molecules having a length of at least 20, 25, 30, 40, 50, 75 or 100 consecutive nucleotides in length, or between 50 and 400 nucleotides in length, are isolated from a blood, serum or plasma sample of a patient. These circulating cell-free DNA molecules are hybridized to a microarray that is described above in the context of the kit invention to determine if one of the circulating cell-free DNA molecules hybridizes to any one of a plurality of oligonucleotide probes under stringent conditions. Each of the oligonucleotide probes has a nucleotide sequence identical to a part of the sequence of a chromosomal region chosen from Tables 2-5 or a sequence set forth in Tables A-D). Thus, if a circulating DNA molecule hybridizes under stringent conditions to one of the oligonucleotide probes, it indicates that the circulating DNA molecule has a nucleotide sequence falling within a chromosomal region set forth in Table 2, Table 3, or Table 4. If so, a diagnosis of prostate cancer is made. In the case of a patient treated with a therapy for prostate cancer, recurrence is indicated if a circulating cell-free DNA falls within a chromosomal region set forth in Table 2, Table 3, or Table 4 is detected. In preferred embodiments, a diagnosis of prostate cancer or prostate cancer treatment failure or recurrence is indicated if two or more circulating cell-free DNA molecules fall within 2, 3, 4 or more chromosomal regions set forth in Tables 2-4, preferably all such chromosomal regions being in the same table, e.g., Table 2, Table 3, or Table 4.

In the above various embodiments, preferably the circulating cell-free DNA molecules have at least 25 consecutive nucleotides in length (preferably at least 50, 70, 80, 100, 120 or 200 consecutive nucleotides in length). More preferably, the circulating cell-free DNA molecules have between about 50 and about 300 or 400, preferably from about 75 and about 300 or 400, more preferably from about 100 to about 200 consecutive nucleotides of a unique sequence within a chromosomal region as set forth in Tables 2-5 (or of a unique sequence set forth in Tables A-D).

Detection of Circulating Nucleic Acids in the Blood

In order to detect the presence of circulating nucleic acids in the blood of patients that may have, or are suspected of having, prostate cancer, a blood sample is obtained from the patient. Serum or plasma from the blood sample is then analyzed for the presence of a circulating cell-free DNA or biomarker as described herein. Nucleic acids can be isolated from serum or plasma using well known techniques, see, e.g., the example sections. In the context of the current invention, the nucleic acid sequences that are analyzed are DNA sequences. Thus, in this section, methods described as evaluating "nucleic acids" refers to the evaluation of DNA.

Detection techniques for evaluating nucleic acids for the presence of a biomarker involve procedures well known in the field of molecular genetics. Further, many of the methods involve amplification of nucleic acids. Ample guidance for performing is provided in the art. Exemplary references include manuals such as PCR Technology: *Principles and Applications for DNA Amplification* (ed. H. A. Erlich, Freeman Press, NY, N.Y., 1992); *PCR Protocols: A Guide to Methods and Applications* (eds. Innis, et al., Academic Press, San Diego, Calif., 1990); Current Protocols in Molecular Biology, Ausubel, 1994-1999, including supplemental updates through April 2004; Sambrook & Russell, *Molecular Cloning, A Laboratory Manual* (3rd Ed, 2001).

Although the methods may employ PCR steps, other amplification protocols may also be used. Suitable amplification methods include ligase chain reaction (see, e.g., Wu & Wallace, *Genomics* 4:560-569, 1988); strand displacement assay (see, e.g., Walker et al., *Proc. Natl. Acad. Sci. USA* 89:392-396, 1992; U.S. Pat. No. 5,455,166); and several transcription-based amplification systems, including the methods described in U.S. Pat. Nos. 5,437,990; 5,409,818; and 5,399,491; the transcription amplification system (TAS) (Kwoh et al., *Proc. Natl. Acad. Sci. USA* 86:1173-1177, 1989); and self-sustained sequence replication (3SR) (Guatelli et al., *Proc. Natl. Acad. Sci. USA* 87:1874-1878, 1990; WO 92/08800). Alternatively, methods that amplify the probe to detectable levels can be used, such as Qβ-replicase amplification (Kramer & Lizardi, *Nature* 339:401-402, 1989; Lomeli et al., *Clin. Chem.* 35:1826-1831, 1989). A review of known amplification methods is provided, for example, by Abramson and Myers in *Current Opinion in Biotechnology* 4:41-47, 1993.

In some embodiments, the detection of biomarker in the CNA of a patient is performed using oligonucleotide primers and/or probes to detect a target sequence, wherein the target sequence is present in (e.g., comprises some unambiguously assigned portion of) any of the chromosomal regions listed in Table 2, Table 3, Table 4, or Table 5). Oligonucleotides can be prepared by any suitable method, usually chemical synthesis, and can also be purchased through commercial sources. Oligonucleotides can include modified phosphodiester linkages (e.g., phosphorothioate, methylphosphonates, phosphoamidate, or boranophosphate) or linkages other than a phosphorous acid derivative into an oligonucleotide may be used to prevent cleavage at a selected site. In addition, the use of 2'-amino modified sugars tends to favor displacement over digestion of the oligonucleotide when hybridized to a nucleic acid that is also the template for synthesis of a new nucleic acid strand.

In one embodiment, the biomarker is identified by hybridization under sequence-specific hybridization conditions with a probe that targets a chromosomal region described herein. The probe used for this analysis can be a long probe or sets for short oligonculeotide probes, e.g., from about 20 to about 150 nucleotides in length may be employed.

Suitable hybridization formats are well known in the art, including but not limited to, solution phase, solid phase, oligonucleotide array formats, mixed phase, or in situ hybridization assays. In solution (or liquid) phase hybridizations, both the target nucleic acid and the probe or primers are free to interact in the reaction mixture. Techniques such as real-time PCR systems have also been developed that permit analysis, e.g., quantification, of amplified products during a PCR reaction. In this type of reaction, hybridization with a specific oligonucleotide probe occurs during the amplification program to identify the presence of a target nucleic acid. Hybridization of oligonucleotide probes ensure the highest specificity due to thermodynamically controlled two state transition. Examples for this assay formats are fluorescence resonance energy transfer hybridization probes, molecular beacons, molecular scorpions, and exonuclease hybridization probes (e.g., reviewed in Bustin, *J. Mol. Endocrin.* 25:169-93, 2000).

Suitable assay formats include array-based formats, described in greater detail below in the "Device" section, where probe is typically immobilized. Alternatively, the target may be immobilized.

In a format where the target is immobilized, amplified target DNA is immobilized on a solid support and the target complex is incubated with the probe under suitable hybridization conditions, unhybridized probe is removed by washing under suitably stringent conditions, and the solid support is monitored for the presence of bound probe. In formats where the probes are immobilized on a solid support, the target DNA is typically labeled, usually during amplification. The immobilized probe is incubated with the amplified target DNA under suitable hybridization conditions, unhybridized target DNA is removed by washing under suitably stringent conditions, and the solid support/probe is monitored for the presence of bound target DNA.

In typical embodiments, multiple probes are immobilized on a solid support and the target chromosomal regions in the CNA from a patient are analyzed using the multiple probes simultaneously. Examples of nucleic acid arrays are described by WO 95/11995.

In an alternative probe-less method, amplified nucleic acid corresponding to a target nucleic acid present in a chromosomal region is performed using nucleic acid primers to the chromosomal region and is detected by monitoring the increase in the total amount of double-stranded DNA in the reaction mixture, is described, e.g., in U.S. Pat. No. 5,994,056; and European Patent Publication Nos. 487,218 and 512,334. The detection of double-stranded target DNA relies on the increased fluorescence various DNA-binding dyes, e.g., SYBR Green, exhibit when bound to double-stranded DNA.

As appreciated by one in the art, specific amplification methods can be performed in reaction that employ multiple primers to target the chromosomal regions such that the biomarker can be adequately covered.

DNA Sequencing

In preferred embodiments, the presence of a sequence from a chromosomal region set forth in Table 2, Table 3, Table 4 or Table 5 in the CNA from a patient undergoing evaluation is detected by direct sequencing. Such sequencing, especially using the Roche 454, Illumina, and Applied Biosystems sequencing systems mentioned below or similar advanced sequencing systems, can include quantitation (i.e., determining the level) of nucleic acids having a particular sequence. Such quantitation can be used in the embodiments of the invention that involve determining the level of a biomarker (some embodiments of which involve correlating a particular level to the presence or absence of cancer). Methods include e.g., dideoxy sequencing-based methods although other methods such as Maxam and Gilbert sequencing are also known (see, e.g., Sambrook and Russell, supra). In typical embodiments, CNA from a patient is sequenced using a large-scale sequencing method that provides the ability to obtain sequence information from many reads. Such sequencing platforms includes those commercialized by Roche 454 Life Sciences (GS systems), Illumina (e.g., HiSeq, MiSeq) and Applied Biosystems (e.g., SOLiD systems).

The Roche 454 Life Sciences sequencing platform involves using emulsion PCR and immobilizing DNA fragments onto bead. Incorporation of nucleotides during synthesis is detected by measuring light that is generated when a nucleotide is incorporated.

The Illumina technology involves the attachment of randomly fragmented genomic DNA to a planar, optically transparent surface. Attached DNA fragments are extended and bridge amplified to create an ultra-high density sequencing flow cell with clusters containing copies of the same template. These templates are sequenced using a sequencing-by-synthesis technology that employs reversible terminators with removable fluorescent dyes.

Methods that employ sequencing by hybridization may also be used. Such methods, e.g., used in the ABI SOLiD4+ technology uses a pool of all possible oligonucleotides of a fixed length, labeled according to the sequenced position. Oligonucleotides are annealed and ligated; the preferential ligation by DNA ligase for matching sequences results in a signal informative of the nucleotide at that position.

The sequence can be determined using any other DNA sequencing method including, e.g., methods that use semiconductor technology to detect nucleotides that are incorporated into an extended primer by measuring changes in current that occur when a nucleotide is incorporated (see, e.g., U.S. Patent Application Publication Nos. 20090127589 and 20100035252). Other techniques include direct label-free exonuclease sequencing in which nucleotides cleaved from the nucleic acid are detected by passing through a nanopore (Oxford Nanopore) (Clark et al., *Nature Nanotechnology* 4: 265-270, 2009); and Single Molecule Real Time (SMRT™) DNA sequencing technology (Pacific Biosciences), which is a sequencing-by synthesis technique.

Devices and Kits

In a further aspect, the invention provides diagnostic devices and kits useful for identifying one or more prostate cancer-associated biomarkers in the CNA from a patient where the one or more biomarkers is a sequence corresponding to any of the chromosomal regions set forth in Table 2, Table 3, Table 4, or Table 5. As will be apparent to skilled artisans, the kit of the present invention is useful in the above-discussed method for analyzing circulating cell-free DNA in a patient sample and in diagnosing, screening or monitoring prostate cancer as described above.

Thus, in one aspect, the present invention provides the use of at least one oligonucleotide for the manufacture of a diagnostic kit useful in diagnosing, screening or monitoring prostate cancer. The nucleotide sequence of the oligonucleotide falls within a chromosomal region set forth in Table 2, Table 3, Table 4, or Table 5 (or matches a part of a sequence set forth in Table A, Table B, Table C, or Table D).

Preferably, the kit of the present invention includes one, two or more (e.g., at least 1, 2, 3, 4, 5, 6, 7, 8, 9, 10, 12, 15, 20, 25, 30, 40 or at least 50, but preferably less than 111, preferably from one to about 50, more preferably from 2 to about 50, or from 3 to about 50 sets of oligonucleotides. Each set comprises one or more oligonucleotides (e.g., from about one to about 10,000, preferably from 50, 100, 200 or 300 to about 10,000). All of the nucleotide sequences of such one or more oligonucleotides in each set fall within the same one single chromosomal region that is set forth in Table 2, Table 3, Table 4, or Table 5 (or match a part of the same one single sequence set forth in Table A, Table B, Table C, or Table D). Each oligonucleotide should have from about 18 to 100 nucleotides, or from 20 to about 50 nucleotides, and is capable of hybridizing, under stringent hybridization conditions, to the chromosomal region in which its sequence falls. The oligonucleotides are useful as probes for detecting circulating cell-free DNA molecules derived from the chromosomal regions. Preferably, each set includes a sufficient number of oligonucleotides with sequences mapped to one chromosomal region such that any circulating cell-free DNA molecules derived from the chromosomal region can be detected with the oligonucleotide set. Thus, the number of oligonucleotides required in each set is determined by the total length of unique nucleotide sequence of a particular chromosomal region, as will be apparent to skilled artisans. Such total lengths are indicated in Tables 2-5 and should also be apparent from Tables A-D.

Preferably, in the kit of the present invention, different oligonucleotide sets correspond to different chromosomal regions within the same table. Preferably, the oligonucleotides are free of repetitive element. Optionally, the oligonucleotides are attached to one or more solid substrates such as microchips and beads. In preferred embodiments, the kit is a microarray with the above oligonucleotides.

In one embodiment, the kit of the present invention includes a plurality of oligonucleotide sets capable of hybridizing to the chromosomal regions set forth in Table 2, Table 3, Table 4, and Table 5, respectively. That is, the kit includes oligonucleotide probes corresponding to each and every chromosomal regions set forth in Tables 2, 3, 4, and 5 (or matching each and every sequence set forth in Tables A, B, C, and D) such that all circulating cell-free DNA derived from any chromosomal region set forth in Tables 2-5 can be detected using the kit.

Use of the oligonucleotides included in the kit described for the manufacture of the kit useful for diagnosing, screening or monitoring prostate cancer is also contemplated. The manufacturing of such kit should be apparent to a skilled artisan.

In some embodiments, a diagnostic device comprises probes to detect at least 2, 3, 4, 5, 6, 7, 8, 9, 10, 15, 20, 30, 40, 50, 60, 75, or 100, or all 110 chromosomal regions set forth in Tables 2-5. In some embodiments, the present invention provides probes attached to a solid support, such as an array slide or chip, e.g., as described in DNA Microarrays: A Molecular Cloning Manual, 2003, Eds. Bowtell and Sambrook, Cold Spring Harbor Laboratory Press. Construction of such devices are well known in the art, for example as described in US Patents and Patent Publications U.S. Pat. No. 5,837,832; PCT application W095/11995; U.S. Pat. Nos. 5,807,522; 7,157,229, 7,083,975, 6,444,175, 6,375,903, 6,315,958, 6,295,153, and 5,143,854, 2007/0037274, 2007/0140906, 2004/0126757, 2004/0110212, 2004/0110211, 2003/0143550, 2003/0003032, and 2002/0041420. Nucleic acid arrays are also reviewed in the following references: *Biotechnol Annu Rev* 8:85-101 (2002); Sosnowski et al, *Psychiatr Genet* 12(4):181-92 (December 2002); Heller, *Annu Rev Biomed Eng* 4: 129-53 (2002); Kolchinsky et al, *Hum. Mutat* 19(4):343-60 (April 2002); and McGail et al, Adv Biochem Eng Biotechnol 77:21-42 (2002).

Any number of probes may be implemented in an array. A probe set that hybridizes to different, preferably unique, segments of a chromosomal region may be used where the probe set detects any part of the chromosomal region. Alternatively, a single probe to a chromosomal region may be immobilized to a solid surface. Polynucleotide probe can be synthesized at designated areas (or synthesized separately and then affixed to designated areas) on a substrate, e.g., using a light-directed chemical process. Typical synthetic polynucleotides can be about 15-200 nucleotides in length.

The kit can include multiple biomarker detection reagents, or one or more biomarker detection reagents in combination with one or more other types of elements or components (e.g., other types of biochemical reagents, containers, packages such as packaging intended for commercial sale, substrates to which biomarker detection reagents are attached, electronic hardware components, etc.). Accordingly, the present invention further provides biomarker detection kits and systems, including but not limited to arrays/microarrays of nucleic acid molecules, and beads that contain one or more probes or other detection reagents for detecting one or more biomarkers of the present invention. The kits can optionally include various electronic hardware components; for example, arrays ("DNA chips") and microfluidic systems ("lab-on-a-chip" systems) provided by various manufacturers typically comprise hardware components. Other kits may not include electronic hardware components, but may be comprised of, for example, one or more biomarker detection reagents (along with, optionally, other biochemical reagents) packaged in one or more containers.

Biomarker detection kits/systems may contain, for example, one or more probes, or sets of probes, that hybridize to a nucleic acid molecule present in a chromosomal region set forth in Tables 2-5.

A biomarker detection kit of the present invention may include components that are used to prepare CNA from a blood sample from a patient for the subsequent amplification and/or detection of a biomarker.

Correlating the Presence of Biomarkers with Prostate Cancer

The present invention provides methods and reagents for detecting the presence of a biomarker in CNA from a patient that has prostate cancer or that is being evaluated to determine if the patient may have prostate cancer. In the context of the invention, "detection" or "identification" or "identifying the presence" or "detecting the presence" of a biomarker associated with prostate cancer in a CNA sample from a patient refers to determining any level of the biomarker in the CNA of the patient where the level is greater than a threshold value that distinguishes between prostate cancer and non-prostate cancer CNA samples for a given assay.

In the current invention, for example, the presence of any one of the chromosomal regions (i.e., biomarkers) listed in Tables 2-4 is indicative of prostate cancer. As appreciated by one of skill in the art, biomarkers may be employed in analyzing a patient sample where the biomarker has also been observed infrequently in a normal patient in order to increase the sensitivity of the detection. For example, the biomarkers indicated by bold font in Tables 2 and 3 have been observed to be present infrequently in CNA obtained from normal individuals; however, given the low frequency of occurrence in normal samples relative to the higher frequency of occurrence in prostate cancer, the presence of the biomarker in a patient indicates that the patient has a 95% or greater likelihood of having prostate cancer. Thus, for example, arrays used to detect the chromosomal regions can include those that identify the chromosomal regions in Tables 2 and 3 that are indicated in bold font.

The biomarkers set forth in Tables 2-4 are associated with prostate cancer, i.e., they are over-represented in prostate cancer patients compared to individuals not diagnosed with prostate cancer. Thus, the detection of one or more of the biomarkers set forth in Tables 2-4 is indicative of prostate cancer, i.e., the patient has an increased probability of having prostate cancer compared to a patient that does not have the biomarker. In some embodiments, the detection of two or more biomarkers set forth in Tables 2-4 in the CNA of a patient is indicative of a greater probability for prostate cancer. As understood in the art, other criteria, e.g., clinical criteria, etc., are also employed to diagnose prostate cancer in the patient. Accordingly, patients that have a biomarker associated with prostate cancer also undergo other diagnostic procedures.

In some embodiments, one or more biomarkers that are under-represented in prostate cancer may be detected in the CNA of a patient. Thus, for example, a biomarker listed in Table 5 may be detected in a CNA sample from a patient where the detection of the biomarker is indicative of a normal diagnosis, i.e., that the patient does not have prostate cancer.

"Over-represented" or "increased amount" means that the level of one or more circulating cell-free DNAs is higher than normal levels. Generally this means an increase in the level as compared to an index value. Conversely "under-represented" or "decreased amount" means that the level of one or more particular circulating cell-free DNA molecules is lower than normal levels. Generally this means a decrease in the level as compared to an index value.

In preferred embodiments, the test value representing the amount of a particular circulating cell-free DNA is compared to one or more reference values (or index values), and optionally correlated to prostate cancer or cancer recurrence. Optionally, an increased likelihood of prostate cancer is indicated if the test value is greater than the reference value.

Those skilled in the art are familiar with various ways of deriving and using index values. For example, the index value may represent the copy number or concentration of a particular cell-free DNA according to the present invention in a blood sample from a patient of interest in healthy state, in which case a copy number or concentration in a sample from the patient at a different time or state significantly higher (e.g., 1.5-fold, 2-fold, 3-fold, 4-fold, 5-fold, 10-fold, 20-fold, 30-fold, 40-fold, 50-fold, 100-fold or more higher) than this index value would indicate, e.g., prostate cancer or increased likelihood of cancer recurrence.

Alternatively, the index value may represent the average concentration or copy number of a particular circulating cell-free DNA for a set of individuals from a diverse cancer population or a subset of the population. For example, one may determine the average copy number or concentration of a circulating cell-free DNA in a random sampling of patients with prostate cancer. Thus, patients having a copy number or concentration (test value) comparable to or higher than, this value identified as having an increased likelihood of having prostate cancer or prostate cancer recurrence than those having a test value lower than this value.

Often the copy number or amount (e.g., concentration) will be considered "increased" only if it differs significantly from the index value, e.g., at least 1.5 fold difference in absolute or relative (e.g., as reflected by hybridization signal) copy number or concentration.

A useful index value may represent the copy number or concentration of a particular circulating cell-free DNA or of a combination (weighted or straight addition) of two or more circulating cell-free DNAs corresponding to the same chromosomal region or different chromosomal regions. When two or more biomarkers or circulating cell-free DNA molecules are used in the diagnosis/monitoring method, the presence or absence of, or the amount of, each biomarker or circulating cell-free DNA can be weighted and combined. Thus, a test value may be provided by (a) weighting the determined status or amount of each circulating cell-free DNA molecule with a predefined coefficient, and (b) combining the weighted status or amount to provide a test value. The combining step can be either by straight addition or averaging (i.e., weighted equally) or by a different predefined coefficient.

The information obtained from the biomarker analysis may be stored in a computer readable form. Such a computer system typically comprises major subsystems such as a central processor, a system memory (typically RAM), an input/output (I/O) controller, an external device such as a display screen via a display adapter, serial ports, a keyboard, a fixed disk drive via a storage interface and a floppy disk drive operative to receive a floppy disc, and a CD-ROM (or DVD-ROM) device operative to receive a CD-ROM. Many other devices can be connected, such as a network interface connected via a serial port.

The computer system may also be linked to a network, comprising a plurality of computing devices linked via a data link, such as an Ethernet cable (coax or 10 BaseT), telephone line, ISDN line, wireless network, optical fiber, or other suitable signal transmission medium, whereby at least one network device (e.g., computer, disk array, etc.) comprises a pattern of magnetic domains (e.g., magnetic disk) and/or charge domains (e.g., an array of DRAM cells) composing a bit pattern encoding data acquired from an assay of the invention.

The computer system can comprise code for interpreting the results of a study evaluating the presence of one or more of the biomarkers. Thus in an exemplary embodiment, the biomarker analysis results are provided to a computer where a central processor executes a computer program for determining the likelihood of a patient that has prostate cancer.

The invention also provides the use of a computer system, such as that described above, which comprises: (1) a computer; (2) a stored bit pattern encoding the biomarker testing results obtained by the methods of the invention, which may be stored in the computer; (3) and, optionally, (4) a program for determining the likelihood of a patient having prostate cancer.

The invention further provides methods of generating a report based on the detection of one or more biomarkers set forth in Tables 2-5.

Thus, the present invention provides systems related to the above methods of the invention. In one embodiment the invention provides a system for analyzing circulating cell-free DNA, comprising: (1) a sample analyzer for executing the method of analyzing circulating cell-free DNA in a patient's blood, serum or plasma as described in the various embodiments above (incorporated herein by reference); (2) a computer system for automatically receiving and analyzing data obtained in step (1) to provide a test value representing the status (presence or absence or amount, i.e., concentration or copy number) of one or more circulating cell-free DNA molecules having a nucleotide sequence of at least 25 nucleotides falling within a chromosomal region set forth in Table 2, Table 3, Table 4, or Table 5 (or having a nucleotide sequence that is a part of one of the sequences set forth in Table A, Table B, Table C, or Table D), and optionally for comparing the test value to one or more reference values each associated with a predetermined status of prostate cancer. In some embodiments, the system further comprises a display module displaying the comparison between the test value and the one or more reference values, or displaying a result of the comparing step.

Thus, as will be apparent to skilled artisans, the sample analyzer may be, e.g., a sequencing machine (e.g., Illumina HiSeq™, Ion Torrent PGM, ABI SOLiD™ sequencer, PacBio RS, Helicos Heliscope™, etc.), a PCR machine (e.g., ABI 7900, Fluidigm BioMark™, etc.), a microarray instrument, etc.

In one embodiment, the sample analyzer is a sequencing instrument, e.g., a next-generation sequencing instrument such as Roche's GS systems, Illumina's HiSeq and MiSeq, and Life Technologies' SOLiD systems. Circulating cell-free DNA molecules are isolated from a patient's blood or serum or plasma, and the sequences of all of the circulating cell-free DNA molecules are obtained using the sample analyzer. The sequencing instrument is used in sequencing the circulating cell-free DNA molecules, and obtaining the sequences of these molecules. A computer system is then employed for automatically analyzing the sequences to determine the presence or absence or amount of a circulating cell-free DNA molecule having a nucleotide sequence of at least 25 nucleotides falling within a chromosomal region set forth in Table 2, Table 3, Table 4, or Table 5 (or having a nucleotide sequence that is a part of one of the sequences set forth in Table A, Table B, Table C, or Table D) in the sample. For example, the computer system may compare the sequence of each circulating cell-free DNA molecule in the sample to each sequence in Tables A, B, C, and D to determine if there is a match, i.e., if the sequence of a circulating cell-free DNA molecule falls within a sequence in Table A, Table B, Table C, or Table 2 or within a chromosomal region set forth in Table 2, Table 3, Table 4, or Table 5. The copy number of a particular circulating cell-free DNA molecule is also automatically determined by the computer system. Optionally the computer system automatically correlates the sequence analysis result with a diagnosis regarding prostate cancer. For example, if one, two or more circulating cell-free DNA molecules are identified to be derived from a chromosomal region in Table 2, Table 3, or Table 4 and preferably two or more circulating cell-free DNA molecules with sequences falling within different chromosomal regions from one single table chosen from Tables 2-4, then the computer system automatically correlates this analysis result with a diagnosis of prostate cancer. Optionally, the computer system further comprises a display module displaying the results of sequence analysis and/or the result of the correlating step. The display module may be for example, a display screen, such as a computer monitor, TV monitor, or the touch screen, a printer, and audio speakers.

The computer-based analysis function can be implemented in any suitable language and/or browsers. For example, it may be implemented with C language and preferably using object-oriented high-level programming languages such as Visual Basic, SmallTalk, C++, and the like. The application can be written to suit environments such as the Microsoft Windows™ environment including Windows™ 98, Windows™ 2000, Windows™ NT, and the like. In addition, the application can also be written for the Macintosh™, SUN™, UNIX or LINUX environment. In addition, the functional steps can also be implemented using a universal or platform-independent programming language. Examples of such multi-platform programming languages include, but are not limited to, hypertext markup language (HTML), JAVA™, JavaScript™, Flash programming language, common gateway interface/structured query language (CGI/SQL), practical extraction report language (PERL), AppleScript™ and other system script languages, programming language/structured query language (PL/SQL), and the like. Java™- or JavaScript™-enabled browsers such as HotJava™, Microsoft™ Explorer™, or Netscape™ can be used. When active content web pages are used, they may include Java™ applets or ActiveX™ controls or other active content technologies.

The analysis function can also be embodied in computer program products and used in the systems described above or other computer- or internet-based systems. Accordingly, another aspect of the present invention relates to a computer program product comprising a computer-usable medium having computer-readable program codes or instructions embodied thereon for enabling a processor to carry out the analysis and correlating functions as described above. These computer program instructions may be loaded onto a computer or other programmable apparatus to produce a machine, such that the instructions which execute on the computer or other programmable apparatus create means for implementing the functions or steps described above. These computer program instructions may also be stored in a computer-readable memory or medium that can direct a computer or other programmable apparatus to function in a particular manner, such that the instructions stored in the computer-readable memory or medium produce an article of manufacture including instruction means which implement the analysis. The computer program instructions may also be loaded onto a computer or other programmable apparatus to cause a series of operational steps to be performed on the computer or other programmable apparatus to produce a computer implemented process such that the instructions which execute on the computer or other programmable apparatus provide steps for implementing the functions or steps described above.

The following examples are provided by way of illustration only and not by way of limitation. Those of skill in the art will readily recognize a variety of non-critical parameters that could be changed or modified to yield essentially similar results.

EXAMPLES

Example 1

Identification of Prostate Cancer-Associate CNA

Sequencing of CNA:

Sera from 197 patients having biopsy-proven prostate cancer with a Gleasson Score of 3 to 10 were used. The data were compared to samples obtained from 92 male apparently healthy blood donors (normals).

After extraction of DNA from serum or plasma, using standard silica based methods, a whole genome amplification was performed in duplicate. The products were pooled and used for further analysis.

Long Sequencing Runs:

The primer sequences for 454 sequencing were added to the product using fusion primers in not more than 20 cycles of PCR. The resulting product was treated according to the 454 sequencer manual and used for direct sequence detection.

Computational Analysis:

The sequence reads were appointed to the sample source by reading the identifier sequence string and all non source parts were cut out (e.g. primers).

The origin of the circulating DNA was investigated by local alignment analyses using the BLAST program using high stringent parameters (30). Repetitive elements were detected and masked by using a local install of the Repeatmasker software package (31) using the repbase (version 12.09) that was obtained from the Genetic Information Research Institute (32). After masking of the repetitive elements and region of low sequence complexity each sequence was subjected to sequential BLAST analyses querying databases of bacterial, viral and fungal genomes and the human genome (reference genome build 37.1). Bacterial, viral, fungal and human genomes were obtained from the National Center for Biotechnology Information (NCBI, (ftp.ncbi.nih.gov)). After each of the sequential database searches all parts of a queried sequence that produced significant hits (e<0.0001) were masked and masked sequences were subsequently used to query the next database. Masked nucleotides were counted and subtracted from the total nucleotide counts resulting in the amounts of unidentified nucleotides.

For each query fragment and each database search, the highest scoring BLAST hit with a length of more than 50% of the query sequence was recorded in a SQL database. The highest scoring BLAST hit was defined as the longest hit with the highest percent identity (maximum of hitlength× identity). For each of the sequences, the start and stop positions for query and database were recorded.

Disease Association Analysis:

To investigate which sequences/sequence tags are disease associated, all alignments that could be unambiguously placed on the human genomic database (*Homo sapiens* Build 37.1 ncbi nlm mapview website) were used. Those were categorized into 4060 region of 750,000 bp intervals and selected for differences between normal controls and cancer patients on the basis of a group comparison using the non-parametric median test. Five hundred chromosomal regions having the lowest p-values were used for further analyses.

In 347 rounds of bootstrap random selected samples linear multivariate regressions modeling was performed using the above selected 750k regions as independent parameters. The 347 rounds of bootstrap yielded $8.9 \times 10^7$ models. From these, the best 42 independent variables (750k pieces, based on $\Sigma AIC\omega_i$) were chosen and are shown in Table 1.

Selection of Clusters in the Pre-Selected Regions

As a second step, a cluster search within the 42 regions was performed and clusters of cancer samples were found that did not contain any normal samples. Additional clusters were searched where only one or fewer normal samples were found in a cluster of at least 10 cancer samples. The cluster regions were restricted to those that had a distance to the next normal hit of at least 200bp. Given these limits, 88 clusters were found, of which 25 contained one hit in the normal group. A sample is called positive if at least one hit is found in any of the cluster regions (see Table 2). A selection of 30 clusters without false positives covering 441 kbp was sufficient to provide a 94% sensitivity and 100% specificity, which can be increased to 96% when two more clusters with a hit in one normal was included, achieving a specificity of 99%.

Selection of Genomic Clusters

A search for genomic clusters was also performed over the whole non-repetitive genome. The limit was set to have more than 18 independent patients hits per cluster, where over 600 clusters with not more than 1 hit in samples from normals was found. A selection of 22 clusters covering about 475 kbp was sufficient to give a rate of 99.5% true positives at a 99% true negative level (see Table 3). Excluding those two regions that had one hit in the group of normal, non-prostate cancer patients, the true positive rate was 96% and consequently 100% specificity.

Example 2

Identification of Additional Biomarkers that are Over- or Under-Represented in Prostate Cancer In a further analysis to identify biomarkers, a subset of 77 Prostate Cancer samples and 70 Controls were sequenced on a Life Technologies SOLiD4+ System, which is a high-throughput sequencer that typically can run hundreds of millions of sequences of lengths of about 30 to about 75 bases in parallel. (Another example of such a sequencing technology is the Genome Analyzer (Illumina)). Briefly, samples were prepared as described for the 454 sequencing, where adaptors specific to SOLiD sequencing are used. For each sample about 5 million reads of 40 bp were achieved and aligned to the human genome (Build Hg18) using the Lifetechnologies "Bioscope" software suite with default stringency values. All uniquely aligned reads were used for further analysis.

In order to define the chromosomal regions, where samples of either group cluster in comparison the second group, all hits are ranked in order of their appearance on the chromosomes. Biomarker regions were initially defined as those regions where at least 15 hits covering at least 10 samples of a group were counted, but not more than one sample of the other group demonstrated a hit.

In 1000 round of random resampling the samples were divided into a training and validation set of 50% of each group. For each region, a sample in the region was assigned a score of 1 if the cluster was a prostate cancer (PrCa) cluster and a score of −1 for region where normal samples clustered. The average AUC for the validation set was found to be 0.92 if the score sums of 42 cluster regions are used. The regions used in the 1000 round of re-sampling were ranked according to the number of round in which either region participated. Tables 4 and 5 shows the 56 highest ranking regions. Table 4 summarizes those clusters identified in this analysis that were overrepresented in prostate cancer serum samples. Table 5 summarizes clusters identified in this analysis that were underrepresented in prostate cancer serum samples; the ROC curve using the 42 highest ranking regions is shown in FIG. 1. The AUC below the ROC curve was calculated as 0.96 (0.886-0.996) with and accuracy of 92% (86%-97%).

All patents, patent applications, and other published reference materials cited in this specification are hereby incorporated herein by reference in their entirety for their disclosures of the subject matter in whose connection they are cited herein.

---

Lengthy table referenced here

US11414706-20220816-T00001

Please refer to the end of the specification for access instructions.

---

Lengthy table referenced here

US11414706-20220816-T00002

Please refer to the end of the specification for access instructions.

---

Lengthy table referenced here

US11414706-20220816-T00003

Please refer to the end of the specification for access instructions.

---

Lengthy table referenced here

US11414706-20220816-T00004

Please refer to the end of the specification for access instructions.

Lengthy table referenced here

US11414706-20220816-T00005

Please refer to the end of the specification for access instructions.

Lengthy table referenced here

US11414706-20220816-T00006

Please refer to the end of the specification for access instructions.

Lengthy table referenced here

US11414706-20220816-T00007

Please refer to the end of the specification for access instructions.

Lengthy table referenced here

US11414706-20220816-T00008

Please refer to the end of the specification for access instructions.

Lengthy table referenced here

US11414706-20220816-T00009

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11414706B2). An electronic copy of the table will also be available from the USPTO upon request and payment of the fee set forth in 37 CFR 1.19(b)(3).

SEQUENCE LISTING (1972 sequences)

SEQ ID NO: 1 - DNA, 1075 bp, Homo sapiens
actttcattaagcatggaatgttattttaactgatactactatatataccataactaatattgtggcttttgtttgtaagtataggtcaaaatgaggatgtaattcatatcataattaagcatatattctgaattgcatttcttttgattctggacaggattaccttgaagttaaaagattaattttcccaagattttactttcttagcaatgccgagcttcttgatattctagctgatagcagaaatcctgagtctgtacaggtaataacatctttctctgctcagcaatattatattagcgatattcagatcacaattcaataatattactgacatttgtttctggttcacagcctcatcttgtgaaatgctttgaaaatataaaacaattattgatatggaaacaagacattggccctcctgctgtaaaaatgctaatatctgctgaaggggaaggtctcgtgctgccaaagtatgataaatgttacaaactgtttagattctgtacaacgtcattatttaaaatctctgctttgaaatttttgatatattataaaagtgcgctaagcaaactgtttcttcaaagattatatccttacgtaaatatacttttgcctttccatattccctacaatacataatctcacctttgctctaattaaaagttgagaaagcagtcttcaaactcctgggtgcattctaatttgcacttacattttgttctgtcattaaattctgccttaagtttcctactctctttttagtgctttttccctttttggttttagtatatgaatatagataagaagaaaattggctatttggagttgttgatgctactcccactactgcttctgctgatctctggtttcactgtggtttgctcccaggcaataatgacaaactaggtccttccattacactggttcaatttgccagccccagcaagggctctctaacctttggcaagtggtcctgatgtaagttgatttttaaaaaaatgctgtgcccaacccttcttatctaccaaaatccctattccaaccctgctgtttaaaagatccagtgaggaa

SEQ ID NO: 2 - DNA, 415 bp, Homo sapiens
ttccagtgaggaatccaaaactgttttataacacaatttgtttatcttgtaaataccattttacatgaaacttatttattgtgtaaattcatgattttgatatcagaatttcctaaagcatgttcatatgttttctgcatagttttcaaaattaagatttagaaaaaccaaaaggcagtagtagtcctttggcccatgaatattattaaagtatgtagaaaatttagtctacaggcttgtcaaaggactgaaacatgaattaaaaaataattcttcatgatattatttttgaaactaattttaggaaaattcgtgtaagaagtgctgtagaacagtggctggtaaatgtagaaaaaagcatgttcgatgtgctaaaaaagtaagtacaattttcaaatcctaaaattatatattt

SEQ ID NO: 3 - DNA, 483 bp, Homo sapiens
tttttaaaactcacttatctactaatctaagtgagaaatatccagaaaagaatatggagtcaaatctcttatgaaatgggttttaatggaacatgatgacacatgatgactaaatggaaaataatcacttttacagtgtaactgtcagtttgagagtgtttacatgcacaaccttcagatggcttttgtgtacgttgagattcagctgtatcagaaaactgttcaggatctgaactctgctcagtagggctcccgtttgagcacacctcactactttgcattttggttctacttttacttcctaggattgtttacttggcttactctttctaacgttctccttttcatatttaagtctatcattgcatctgtttagaatgaagaaaaaaacctcagagcgtgaactttcaaaactaacttgactagaactgttatattgtatttctaattattcattgttggtaatagaaaggctattgactt

SEQ ID NO: 4 - DNA, 101 bp, Homo sapiens
tttttttctaaagagaatgtacaagtacattcatcaaatgtaacagatcgttggcagtactttatcttaccagaaaacatcaatagaagatttttatactc

SEQ ID NO: 5 - DNA, 786 bp, Homo sapiens
tactggtgagtccctcttctaaaagcaaatactagtttctaactacaacaacctatatgccgtggttgcaactgacaagcagggcatgtggaaggacctagtctgtgagtaacttgccttttagtgcatgaagttccttcccatttctcctggaggtcacaaactacttgtgacactctactgtgcctctaggtcagcacgttttaagtattccatatacttatagtatatcaatgcgagtgtgcagtaagatcttcattaaaagattttgtcaaaagagaaatgtaactatatgttgtttgagagatgtatagcaatgtgacaaaaaagttatgaataaaagtcataaggacttttcatggaactgccaacaaaaagtgtttaaaaataaaattaagttccaaaggtattaaataaaataaagaatcatttgtagttgatggaagagacatttcacactgatactgctttgaaatgtataaaaagttgttattgacatatttctcctcatcagcaatgataaaaaaacaaaaatagataccatttgcaagcacaacaaaaattaaaaggttcagtacttcatttcaaatattcaaatacattctaaatgaattttagagtgatacctaagaaagaaagccaaattagaagaaaataaaatgaaatttagtgttgagaatttctaagagatatagtatcaatgatttaaaaaaatgtatcattgaccgatttgactataaggaaacttaaaactccatatggaaaaaaatgacaacattgaaacct

SEQ ID NO: 6 - DNA, 226 bp, Homo sapiens
ctttttatatatttttaccatctcagaaactcaatggccttattagaaaagtacagataatctcaaaaaggaatttaaggagtatgcattatgcttcgattaaggctctgttacctttatttggtctgatttctacgttagaacaaagaaatcagagatcttaaaggaaaactcccctgtgacctcgtcatgcttggtcattaaatggccacaatcaatgattaag

SEQ ID NO: 7 - DNA, 122 bp, Homo sapiens
gtagatttttaagtcaagggattgaagactggaactgccagatgttttcccaatgggtgttatctcatccaggacaagtggtacttactgtggtaagttaatgctgctttgatgtatgtata

SEQ ID NO: 8 - DNA, 63 bp, Homo sapiens
tataagtatttagtttgtggctacattgccaagaaagaaatgatttggaaaataaatcattat

SEQ ID NO: 9 - DNA, 84 bp, Homo sapiens
tgaaaatctttataattttgaatgaaagtagaactattttcttaaagatgtcactatattgtattgcattagttttctactgct

SEQ ID NO: 10 - DNA, 488 bp, Homo sapiens
tgcatatttgctagagctaattattgtttttctgggtctcataagagagagggaaaactaggaagttgtgatgtcaataaaacaaaaattggcagttcttttgagaagtgtggttggagccaggggagtgataaaatttcccctaacagcatgtgtagaataagagaagagggacaaggaaagactccaagaaacatgaacagctaaggaataggcaaaagaaaaggactgaaaaagagtggccaaaacagaaaagaaatttataagagtttccatggaagaagctaaagaggaagaaaggtaggtttttgtttgtttctttgatttttctccagaaaaactgagtaatcatttaaaaaagtgagtggtcatcatttttaaagactctacagagatcggtaaactatattatatctgtcaacagtggttttctggagtgatgaagatagaagccatattgccaggaggtaccattatcaagttgttgt

SEQ ID NO: 11 - DNA, 1128 bp, Homo sapiens
ataatcaagtatttttaaagcatacttgacttgtagttctctattcaatttaaaattaacatcatatccttttactttgccttgactcacaattttcaagtctttgttaaaataaccttggattgtggacacaagttattattatcaaatcttctttgtcccttttgttctccacttgactgaatattgaaaatatccacagatcttaagctgaggaacttacccaaactgttctttacaaaggtgacaaaattataatgaatcaatctgcacacttctgtagtttaacaggaattcaaataatcaaatctgctctcctaagataagatgtttcctggatccctggtcttccaaacatgcttaatgataagcagcctgtattctgtttctagaaatactttatgatagacttcagcttcaatcattgaatgttcttttgccaaagtttttcacacatctgccttacctactgctcattttccattgatgcagtttacaactcccctttctcttgcacttctacgtatgtcacatgactaggagttgtctctgaatggaagtaaaaagacacatgggagaatgcagataattagatgtccgcatgcattggccactgaaggaatttgaacatggaattaataaagatatagtaattaaaaattcctttataaataaataacaaacagtaattaaaaactggttcacaatctctctcgccagaaccaagtcctcctttaccctacactgatgcagcctagggaggggtctccacctgttggatgttctctcctgaggctgcaaatcttgaataaatgtctcaagggcagcagtactggcatctgaccagactctgccgtgacatggccttgactgtgattcctcttgtcttcccagactcttggtcctgcccactttctaaccctcagtctctagcatccttttgatctgctcatcatgagcttgcaacatcctttaggaaagccagttcatttctgttgcatgtaaccaagaatgctgttgatataacaagtttctcatcctgtatgctcctatctcgatctggaaaaatctcactctgtctgttaactttatgctaattattcccacattcatatcttgatagctctt

SEQ ID NO: 12 - DNA, 853 bp, Homo sapiens
gttatgtatgacaagagtgggtgtcaaaagatgggccaaataacagaagtctgtaaactttctgaaaactatgactacatactcactgtgttctaggtatattacttctgagtccagcagagaaagcagcactaatatatcatcttggagttttccaccatttttactgtccccaggttattacttaaggttgctggtgtaagagttaggaagatttaagaatataagacttaggaagtacaaatggataaggcccccataagcatcaatcagaattcaatctttagccctcaaatacacacaaatgtgtaaggtctcttacacaaacacttacatacacaccacataaactttatgaaaacatccattttaatttgaataaaatttatgcttcaattatatatatatagagagagatatatatataacattatcttactttttcagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaaggtaggtggatctaaattataactacatacaataacttctcccaaatatatctttaggtaaattgattctctacctcacactttgtcaaacttgagttttaattttgggggctttaccaaaattctaagcaaactgtaccaatctgagtatat

SEQ ID NO: 13 - DNA, 756 bp, Homo sapiens
caccctactactgcttttccttctttctcttttctactgtccctccacctcatttttacttctttctgctttgtcttcctgacctgattaggcccttttgatagttacattctcccatttccatctagacagagggcagtatctttccatgggcattcagagctctacctccagcctcttctttccgctgtgctgttaattctggaacagactgaggggaaacaaactgaagaacatttccagccagctccctaactcaaaactgccttcctcctacctggagtcaattagtaaaatatgaaagtatagaaaattagggccattctcacctttagtgagaagagattgagtatcaagctctgataataaatgtacggttagcataaattctgcagttagcataaaagtccttattttaggtatgacagtttcctttaaactctagaaaaatgaagcagacagaggcttaagtatgtaactgaggccactgttgactatattttatctgaatactttatatctgatatatactcacatgttcattaaagcataaatgtatactttcttaattgccaaagaggatatattgtattaatgaaccattactctggaaaaagtctagtgtgtcattattactttttattaactctttttaaaaatgagaatgaaaaagaggaagagcatatatagaaaggtaaactagaaaagagaagattctaataagactctgtaagtgtctatgagtttagggctata

SEQ ID NO: 14 - DNA, 214 bp, Homo sapiens
ttctaagggaacactaatggaaagggaaaggctctggaaattgattttctatcaaaataatgatttggcactctacttgaatcataaaacaaatacaggttcttaggataacaaaatttcttctttaaaaaaacattttcttccacaagtgttatacttttctctctcttgtggatatatgctctctcatctgagacttttgcaaggtagtagc

SEQ ID NO: 15 - DNA, 201 bp, Homo sapiens
tactacatgatagcatatgttgagagtgagtggaatgagtgaataaaggcaaacaaaggcaaaaactagtgcctgtgtaagagctttgatgactaaattctgagaagatattgtacctgcctccacttgtaattcaaaatcaaaacagcactaaacaattaaaaatgtgtaggaatgagtttttgcttgacaatgttttaa

SEQ ID NO: 16 - DNA, 293 bp, Homo sapiens
ctttacaaaatattgtttgatactttttcattgatagtgctcaaatgtgtttattttgagaattgagttagcactaactgggatataaaatagagtcaagaattcataccacaaagctacaaatagttcataaatgtaactcaaaaccttctagatgtgaacatttatggttagctacacaattcacagtgctcatgatataaatacaaatcaatttctacaaagttcaatttgttttgatacatagaacaaatagcatttctcttaagtacactcataataaggatccagat

SEQ ID NO: 17 - DNA, 792 bp, Homo sapiens
ttcttatataaatcctccatttgggttgacatcacaccaaagcagcatgattcagcaaggccattagcctcagagggaagcatgttcacatgtttttattcttcagttctactatttcatacctaatatgatcagtcattgatgagttttatatcacacttctcatttgattttaattttttaacttctatttgtttttttaatcaatgctccatttttaatcttgattctttttctgcatgtgaaaatacataaaaataatttaaccaaataatatgaacatttaaaatttggctttcagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaagtaagtggtttctgtatccagaataaaaacttttttctttttctgtcacacaaactttgatgttatcttaaatttacaccattcctgctattaagatgttcattgcattaacaagcacattcattaactcacatataattaattcatcaatgatgttttgaatgcctattgtgtgctggagcttagaatctcaataagccaacatatgctttttatttagttggaatactactttactgactaacatgtgaatgattaa

SEQ ID NO: 18 - DNA, 594 bp, Homo sapiens
aaagcagtagtagttactgatgaaagcaaaggatatagtttgtgacctagaattttttcatagttttttattcatagatttatgtaaaaacatgaccttaatgctctataaactaatcaactgaactgtaacagtatatgtacatttatactattatattgagttttgtgaatctctaaatttgatttttaattcatctccatattgcaaagttttctcaaaagcataaagacattttattactctagcagttttaacattagtattttgtgtcataattcaagaaagatactaaaatatttttgtttcccagtccttaggcaaacattgtgtggtcttcaactgttttgaggatttggattataaggtaaaccttaaacatatgtgtcaggaagaaatattgtacacataaaacataaaacaattcattgaagaataaaagaacaagaaaaatatttatctgagacaaacatcaagtattaacagaactttaaatgctgttacttcttttaaactaatggactagaaacctagaatgtaatagaaattttaaacatatacgatgcttttattcaggtgaactactccttaaga

SEQ ID NO: 19 - DNA, 467 bp, Homo sapiens
attaacatacatttattttaagtcctaaccccatacatttatttactgaaaaggtaatcattaagacaagattatgattaacacaaatatttgagtgtttatatagataatgattacaagtttgtcagtcttgtttcgtttgcacattatctgacataacattctgaaatatgtctcttacaaatctactcaaagtttcaaaatactgcaatttgttttgcatgttaagtccaaacattctacattttattgttgtcattttatttgtgttcaaagcatattacctctgagatcctgcatttccaatttgtgctcacttagtacgttaaaaatatcaacataaataagttgatcaattattatttttaagatacttaccaaataagactctcttgcctccttcctggaaaccactagtggggcctatgagggctccacatgagtgaggccaaaaagcctgctaatta

SEQ ID NO: 20 - DNA, 250 bp, Homo sapiens
ctgctcagtggaaggaacaatcttctacatccttctcggtctgaggctctcacttactcattccgattcccacttcctttcctccttgccatacctagcaatagagttcaggcacccctcaacttgcattcagcccacagaagttaggcctgtcaatatttttgtttgttttgttgctttgttttagttgctaacatttacaaaccaatagatttcaatcccagacttgcagcctctcacagaacactgc

SEQ ID NO: 21 - DNA, 62 bp, Homo sapiens
cccactgcagtcttgccttatctgggcctgtggttcagtcttttgcattgcccatcagctgc

SEQ ID NO: 22 - DNA, 108 bp, Homo sapiens
ctgaagactctgccccagggtgcagctgtgtgagggaaatggctgtccagggagggatctggtacatctctgtgcaatccgtcagaagctgtggccctgtcttcacgg

SEQ ID NO: 23 - DNA, 466 bp, Homo sapiens
ttataataattttagtaatcaatctctttttttttttaaaagatagtgagaaaatttttctttggactagttcagtcaggagcatggagttgttttgatgaattcaatctaattgatttggaagttctctctgtcattgcctcacagatcctaacaattaaggctgcaaaagacaactattctgccaggtatttgtcgaatgtgtttataccttttgaattgaaatctgatacacacttaatgtttagttaattattgttaaatattttccccaataagtgtttaggtctttggggtgttttttttttaaagcacataccaaaaggaatggcagttaccttgaatgtttccattacttggcaaataatgtgaatatatttataactctaactttcaggccaacttagaagtacccaaattcttgcccaagctttggaacagtctcctgagctaccaggacactgat

SEQ ID NO: 24 - DNA, 84 bp, Homo sapiens
cagcttaaattttcatattatctttttatcttagaatattgcatttgaagaacccaaacaaatgctgctttttttatttccaca

SEQ ID NO: 25 - DNA, 293 bp, Homo sapiens
tgagataaaaagcaaagtgggtatactggccacatacctgaagagccctcttgtcttattactctgaattaatgtgcttttattgaaaagctctgtaataacagtatttattagtattactaatgtttagcaataaaagcaaaaattttttctctttaggtaattttaatactcatatgatttatggacatataaaattgtatcataatctaatatttctaatgcaagctaatggatactaacttgtggctttcctctcatggattttgttcaaactgttaaagctagtatta

SEQ ID NO: 26 - DNA, 1560 bp, Homo sapiens
atctgtgctgtgccccattctgtgttctactatatcttccaggcagagctcttttattccctaagtgtctcccaggttccttttactatgtaagtcaactcattcagctaggtatcttccagcctcaggtcccagaaacatctttggacataatcaaatacatctgaatcccagcagggatgacaactttggctcagcatgagcctcctatttcttcttttttctctcaccattgttttttccagtgtgctctgtttgcatttaaatgtaacacagccttaataaagcttccaaactcacttatagttttaacatgctttggactagagaaaacagtgctagtgatgaatactgtaatgtcttttaggtttgtactggaaggaaaagaaattcgtatcaatatgtcttgtgcggtatttatcaccatgaatcccaggtaagtatcagtaaatctagtgggaatagacacagacaaaaatcattttcttaaatcttatctacagatggagttgcttgacatttgcatctatccatatatctgtctccaccatcctctgaacacttccactcccaacaccatttatgaacagctgcactctgcacctgttcatatggataaggataatctcacattcattaagctactgacatatttttacttcatgaataccagagagaaaggaaaaagggtcagaagtttttcacaaagaggacccaggcagaaaagctgatgagagtggcaggaggaataagacaatagtgattgcagggagtggaggttgagcagattcaaaaatatctgattgaatgctgtaatagtccaaggaatcagagggaactaatatgaggtcaattgtgggaggaggaacaggaagaaaatatgataaaccaggaagctctgtaagatgaaaggtacaataaaaactatcttgtaaactaattttcagataaaggtcacacagaacaccaatataattattttggggaaaagtatgtgattccttatttgaaaaattgagaagtggtgtttttattgtttgtttttcttttcctcttcagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggtaaatagctacttttctcaaaatatttaaaggtgattatataaaaataaccttaagtaatacttttctggattggtccagggatgacctgggactgtaccaaataatggagctagaattcctatcaaaataatggagctagaatttccatcaacatataaagtccatatgtgagcttcatataaggcaaactgtaaaatcagtcaaggttctaagtctttcctccaagatctggaaagagtgattgagcattcgttattttaaattacggactatttttttccatacaaggaagttaacatctagagcgatca

SEQ ID NO: 27 - DNA, 748 bp, Homo sapiens
ttctagcatatgccagagtatttgttgctaatgcaaaatggtttggacagctaaccacattttctccaaaagtcctcctcttttaattttctttcaatttatctcattctagttcagagaaaacttaattcagataccgatatttcttaacacctttaatatttgttagtctttaagagtgagactttaggagcatcactttgggagatgaatgagagcattagcagtataaccaagggttttttggattcatgtcactgtttccctgcagagcatagattacctgtaatttacctatatactgtgtgcatttgttttcatattttttctttagaaactttaataattcaaatattttaatgtttgataggatcattataattttggcttgagatctctgaagatagttttaataatggctggaacgaagaaacgggagtttaaatggtcagttgaattttgaattgttaggtcaaagggagttatatactgctgggaaaataatttgtagaattacgggtgatgatgccaagttaaaacagggagccccgcagactgtcatagtaaagtaaggcagagattatttaagaatatgaaagaagagtaagaaaaaatgcacaaaatcggagtacttttccccaatagagagcctattctttaaaaaaaagtgttttacataataaaagatataatggaaaaaaagacctcatttagaagaataataactcaatgagaaatgtaaagacta

SEQ ID NO: 28 - DNA, 213 bp, Homo sapiens
gtagaaaggaacaagatataccttttcatattggtatgattggggctatattcatgtactgcctatttaaaattgaaaaaaagatgaatatgttgcaaaaggatctatcaacatgataactgtttcccttttaaaacataataatatggattgctgacagatacatacacatgtaataagtataaaaagggagcaaaggataggggataaagc

SEQ ID NO: 29 - DNA, 352 bp, Homo sapiens
atttatttcttaaaaataaaagaactgaggcatatattgcaaaatggcctgtataatattgatggcatgtaaataggcgtctgttgttaaatgttttatgattttttaacaaagataaatagcactcatatatgaaacccaagtatagctccctgatatcctcaagtcctctggattttatagtcctgtagtcacctagttctttacgtaagtatttcagtgaaagtagtactgctctccattcaaagcacttgattttcttcaaatgacaggaaatctaaagtttgcatgggcacccttcaattagagtttccatttccagtatacaggaaactgtctcctgccactgaaa

SEQ ID NO: 30 - DNA, 270 bp, Homo sapiens
ttcgtgacaccaaaataataattattgttctttcctgtttcctcttcccgtccctgtcccttcctttccttctatcccaccctattcttcctaaggcctctgaccttatttcttagccacccaagaatactacagatttgtctcatttccctggcatagtaattcatccctcccttttttttctactttctctttataaatcatgttggaagaacctaatgttaattctcaaatatactttcagggtgtttaaattaaaatggaaagcag

SEQ ID NO: 31 - DNA, 162 bp, Homo sapiens
gcatttcctggcttacgaccacagcactctaatctgttattgttccgtcaaattacaggaaatgtaacattttcaaatagtcactaaagtaacataacctcagctctagtcaatcagtgtatggcagtcacttggacacaatgactcaaaggtagacacact

SEQ ID NO: 32 - DNA, 138 bp, Homo sapiens
ttttttcttttaagggaaaaaggcagttttctccctctttcctttaaaataattttccaaatctttttgtttagaaaacaaactaattatccaacagctgaagtcctaggacccttgtggtaggaaagattttcttgg

SEQ ID NO: 33 - DNA, 216 bp, Homo sapiens
gtatgatgaagacaatcataatgggtacaacaaggttacattagctatcttacgcttaaattttagttagatgttgacattaatctaaagctttcattatttattcttaaattatgacagatagacccattggtaatttcgcatgccatttccaaaattactcttttgtaatattttaatgaagtgttacctttgtccaataacagaatattgtaa

SEQ ID NO: 34 - DNA, 344 bp, Homo sapiens
gctattttctctccatatctatatttaacacttgccctactaccagacatattggtcatccctgatttttttcattttcctttaagataaagcaagatctgtcttgaaaaaaatattaaaaggccattgtcattccctaggaccccaaaaataaagtctggaacccttttttgctctgatgtggccccctccctttgacttcaagtggactcttgccctctctttgccaaaatacattcagaagaaagactcagcgaggtattctcagggaaatgtaaatgactaaagtcaattccaacccgctataactctcccattgtaataatggagtggttataggaata

SEQ ID NO: 35 - DNA, 171 bp, Homo sapiens
gacacctttgcaggaaacagttttcttcctttctatctctaatatggtatcatagcatgtgtagttacttttttttcttttgattacatgtttaatatatacaatatatactgtagtgtttagtatatgaaatattgttattatagagtaacatatgtagtataacttata

SEQ ID NO: 36 - DNA, 277 bp, Homo sapiens
ggtgtgattgctttgattaaggtttcagtttaatttgtctgagatattctcagtactgcagtcctccatacactggcttgatttcaggctggcttcatttttggtggcaggacaccttctaataataactggggctgtccatattactgaactaaaggcctgaactttactcgagtggactcgtcgcttgtctacccttgagtcaccgtgtccaagtgactgccatacactgattgactagagctgaggttatgttactttagtgaatatttgttat

SEQ ID NO: 37 - DNA, 611 bp, Homo sapiens
gattcaatgtctggggattggtgttgctcttattgttctagaccagtcagagcctatttctggagctggggatctgattaattccacccaaaccatatggctgctatccagtgagagagaggagggaaggacattgggatagccacccctaaaacagaatgttaatggtcttcagtgtctgcagagcagactccctaatttgttctctgtgtttgttttcttctaccattgaagtgataccagtgacagtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggaggtaaaaagacctttgaaaatcatcaccaattatttggatgtggaatatcaattaagaaactagatgtggattaaaaatattacagttcttcctaaattctttattcatgttataattgaggggataaaaatacttggagatatatagtgccccttggggaaaaaaagagctttcagtatattatgtcctaatggaaataagaatg

SEQ ID NO: 38 - DNA, 530 bp, Homo sapiens
tattctgtaattattaaaattacatattataatgacaaagtcctttattgtttctcttatatctatagcctcacagtcattgccttaatctaggtaagaactcaatgtctcttgttaatatttttacatagcttcctaccacaccctgcattccagtattttcccatatggccaccagagttgttttcctaaaatatacatttgaccacgttagcaaagcaactgttggcttaatgttgtctgcagtacaaaattgaaattaagtattttaacatataatgcccttcacaatctggctggacaggttgtcttttcaatatatcctgttcttccttcctctgtctcttcctttcttccctgttctttctaccttgagcttctgttctctgacttttccaggattttatcaggtgtcaggccattaaacatgttgattcctttccctgaaatccaacctgtcttcaaaaaaatacttttaaaatttatttagaaaacaaaccacttcataattatttgttctttaaatataa

SEQ ID NO: 39 - DNA, 109 bp, Homo sapiens
tgatgtaggaaagtttgaaaatctcccttgaaaaccatctggaccaggagttatgagaggatggctctttcatggttctaatctgtgaaattaaatctaaaatttatga

SEQ ID NO: 40 - DNA, 536 bp, Homo sapiens
aatcaaatctgtgattatctgtcctgtatttactgatttttaactttttctatacaatgtatcctgttgtcttaagatatattactgttattattgaatttatttttgcctcagtattttctctcttttcctgctcactatggggtagatcgagttttcttctttgtttgttatatttattctcttttagctgaagactgacattcatgcctcttttagctgatgcctcttttagctgaagactgacattcatcattatttgcccctaggatcaaaatgttttcatatctatatttgtccctttcaagataagtactttagtacactctttggtcttccccacacttccactctcattatgttgatgctatgtagaattataattcctggttgttatagaaatgttttatctctcttttttccttggacttctgcacactcctgcttgtgctctctctctctcttttagaaaatagtaaactcataagaaattgtttcaaacttactttttatatctattataggcttatcttcaa

SEQ ID NO: 41 - DNA, 101 bp, Homo sapiens
agttctcagagtaggtttttgtgtagcaaaccttctgagaactttaatatttgagactgtttttgatataccctcatatctgaatggcaaattcattataa

SEQ ID NO: 42 - DNA, 20 bp, Homo sapiens
ttctaactttaaagttattt

SEQ ID NO: 43 - DNA, 423 bp, Homo sapiens
cagattggttctggatgtactggacacaggttctgtgacatgcactgtttgatcagacatgaaattcaaggctgtgaggtagtctcatcgttctgagcaggaatgtggtatcagaaatagtcataaatatcctaaatccccaaatcgccagcaacagggccttaataccacccactggtctagaaattagtctgaaagtaggttatgctggtatgaagtgggcagctacctgttgcttcaggaaactgatgttactttggctaaatcaggacaggcttgctttcataatttttactaaggaatcaaagcttctcagaaaaatgtgaccaaagctcatctcaaactatagccataaacatcacccaaaattgtcttaaatattacaaaattcccaaatgagctttctccctatacctctccttt

SEQ ID NO: 44 - DNA, 328 bp, Homo sapiens
tccatttttaatactataggaatattgattaaatatgaacacagatactttgtctcacaaaatatcttctgcacattgtctgacttctattcaatatattatcactgtttgtatgttaattcctgatcttcagtaaaacaggaatgtgacctctgatactgagccggcttactttgaggcattcaatgaatatcagtatgacttttctttcatgttcttctcactactatctttctgtttggcaatctctgtggcaaatataatgtttcatttcccttactatctgaattcattcatttgccaaatgtttattgatcattttcttttt

SEQ ID NO: 45 - DNA, 241 bp, Homo sapiens
cctagtaggagataaggttggaggaaaggtgggtgctatcatctgaatatttgtgtctccaaccccccaaattcatatgttgaatcctaacccctaaggtgctggtattaggaaatgagacctttgagggccagacagttgcagttactattttttttttaacaatagtgatatcatattgtcagcttctctcacttatctagatagcaaattttagattctttaaaaaaattaaactttt

SEQ ID NO: 46 - DNA, 39 bp, Homo sapiens
gtttttttttgtttttttgtttttgttttggttggttgg

SEQ ID NO: 47 - DNA, 26 bp, Homo sapiens
ggaggggtattagggagcttgctagc

SEQ ID NO: 48 - DNA, 1517 bp, Homo sapiens
ccaagtcacagactcttaaaacgtaaaaagatcttggagatgatgggcttaatcatttccttttagagtgggagaaaatgaaaccaaagttacaaaatagttgcaatattgggagattccagtgttcaaagctcttttcagtacatcatgttgcctcaatcagatggttttgtttcattttattagatgtgaactcaaattaattgagactttcctccagatgctcaaatttaagaaaaaaattagtattaaattttgtccagtgagcaattaatcttcatttgtaaattaaacttaagaatcatttttcaattgcataagtttgaatcaaaaaatttttaaataaaaaggtattgaacatctactttatgtaaaacaaagggccagtatactttgtaaaatggaccatgttaccaacccacaggtaatgttccatcttagaaatctgtgacaggcaaaaatgtcccagttgtttttatttaaagactaattattaacttgatgctgttctattgggaaacttgtctgtttctacatggtgttttgtttcttcaattttctactagagtatttgccttgttttaaatccttcattgatgtatgactccactgatacaactgccaatggaaggtgttcatttaacttatttaaatagttggaacacaactgagttgtctgagaggatttcctaaattgcttcataaacatgttcaaaggacttattttttttcttctcaagtattaggcagataccaaatataaagctatattgcttagtgtgtcaaaactccatgctgtaattactaacttgttttcctacttgcaagttaaaaaggtcttttaaaaggcacaaattctaacagctctaggtagcatttatttttgtcaaaatgacattaaaacacctttttcttttgacaaaagaccatagtcacacattatacaacaatctgaaaatactgacaagcaaaaatgttctgaaaacatttataatttcaccattggagacttaataacttgatgtacagttttccagacctttttctaggacatatgaatcatattatgtatgtagatgagtgttttagttgaaaagaccctcactttgtgcactttaacagtatttagcacaggatctggggctcttaggctttttgggaagaaggaagcattattaaacatgagattactttctgagtttgtgttattaattgttttttaataatgttaacattttagatctatgtaggtgtaagcttttagactatattcattttgtactattgtactttgggagaaataggctttcaaccacaggaaacagttctgacaactagttgaggatacgaatgaaaggaggtggcagagtgagactgatttctaaagtagtcattgcttaggattatttcttggctatttaccatgtataagcactaatattttattccattagctatgatcaagaagttaagtgtttcttaagccctccaaggattttcttttttaaaaattagta

SEQ ID NO: 49 - DNA, 88 bp, Homo sapiens
tactgttgttgatttatattaggttttccaattttgtcattatatatgccactgcagtgaatatcttttatatatacataaggttgaa

SEQ ID NO: 50 - DNA, 25 bp, Homo sapiens
ttggttaaactttttaaattttaaa

SEQ ID NO: 51 - DNA, 839 bp, Homo sapiens
aagaaaatattttttaggaaaacataaggttgtgcagaattcctaacagtgaaattcaattagtaacatcctattttgaggccttgtggagtttatcgttataaggggggctgttaaattgaccgacagaaacatatgtgtatcgggccagggtggcaactatcatcagtttaaccattctatgaaagccagtttgccacttgtgagaaaaactgagttatgctgtatcctgtttctacatatgtatggacaatcatgattgttcagaataccaattttatgaatttttgattcacaaaatttcattaaagccttaaattcaagatgtttctgaaactggtaaaacttcaaaatggaacattataaaatgaaacagttgtcagtatactgtctttaaacagtcaaacacagccttggtataattgaaaataaaaacttgtaagttctgctgcgcagctggtaatcactatccttagtaccacacatagtatattatacaatccttagtaccacacatagtatattatacatacaaaggtgacttttgtgcatacccaatagcaaaagtgtctgatccgttcagtgccctgcactttgaagatatttttgttagataggtgtggtatcacatacttccaatgttgtttccaattctgtgtatgcttgttccaagacagactttcatgaccctaacccatggtagcttcctgcttgatatttatatacatctgtactgaagtttggaaaggtcacttgaatgaacaatgcttgacagtggtgtcaccaacctttcaatatgtatgttaattataaataaaggcatatctttatacataaac

SEQ ID NO: 52 - DNA, 125 bp, Homo sapiens
tttatatataaactttcatgtatgaaatcataatgtggtttctttgacgagttttataacatcactcattctgcatgattttaaaaaatcagctttactgggttatgatttacattaaatgtacc

SEQ ID NO: 53 - DNA, 95 bp, Homo sapiens
aaaaatcccacttgataataaaatcgagtccaggataataaaataaaaatcaagtgggagtacttttcactctgtaaccaactactgctgaatta

SEQ ID NO: 54 - DNA, 1504 bp, Homo sapiens
ctgtaattattctagcacaatgctaagcacttgcagcaggtgagtggtttgtttcctttacactccctacaagaaatgtgaatgcaatgctcttcagttttggagaacacaggcaaacaactgtatgtgctaaatcatctgacttcattttgatcacaagggcttccaccagccaatgaatacttgctgtgaatgctgcccaatgtcgggcctgaggaaaaccagacagtggcttcatgtcattttttaaatcatgtctgatatatttcattggagcttttcccccccaatacccaaagagatacccaaagagaactctgaaaacaccaataccccaatttcctgctttgtgcctgcatttctctaaatatttccatctgaactttgtctgcgagtattaggtcagatgtctactgtaattaccaggcatcctggggactgtaattaaaaggcagtttgaaatgactgacactttgatggtgattctagccatttctattttctgacaacgaatcttcctcaaaaattttactgccccctcatgtccttgctccctgatttttcttcagttaggcactccgtaattcagcagcattcttttctttccacaatttatctccctactccccttctcatcacttgggtccggccggtgagcaaggaggaagaaacccaaagggatcttcagggtccgcgccccgcaaaaggtctcacagcagagacgtacaggagaggtgacccaacccccggacctggatggggcccttatgggaaaaaccccgtgtttgcttcaggccattctatgcggcatccacgaggtctgtgggccagcggcacggcgcggccctgtcccccaaaaaggaggagaggcaggaggaagaggaagtggccgtacaggccgaagccttgtggagcctcagtgcggggcttggccaggtcctagggggcgtggcctcggaggcgaaagcgcagggcggggccgaggtgtaggaaccgggaggggcctcgtggggggaggagactcgtgggggcggggcccaagggaggcggggtggggcggggccgcggccagaggaagcccctcccggtttcccttgacagggtcacctgcctgcaagccacctgcgctccccttcctctcccacagcctacatgaccagtgtgggtcgccagcctgagcgagggtgctcaggtggtttctactctcattttcactttccagtgccgctgccgacttggaggggagaaaggggcggggcaaaccctggtttcgcccccccgccctcaggctggctgccacgcgggggcgcagtcagggggtctgcgctgtgtgggtagggggtcttcagggctgcccctccgcagtgccaccctaagccaagattcccacccctgaggcaatccaggatgaaatgcacactggctggggtcatgttaagtaacagaagtattcccaggccccagctatctaaaaatattcttccagcttaacgggttagttgcc

SEQ ID NO: 55 - DNA, 532 bp, Homo sapiens
aagtagaaaactggaccctgagaaatacgtacggccaggctaacctgtgagcagcaggacatggcacaccctgggaagcgaagacaaggttctccctccctcccaattgctcatatgtgacatgggtcctctctcagcggctccctgcacaggattcttttttcagagaggctattccatttctctagttttgtgacaccctcttcactgaattccttcactttagcttaagtcttgattgtgtcacctaccccaatgctagtctaaaggactaaagagagtaagcctttcgaggaaagaaagaaaactatataattgctttttatgtattcggtttaaccagccaacttctgtgctacacggtgggaaaacaaagacatatatgacacagaaaagtaactatactccagcattatacatttaataacaaaaacatatggtagacacaaaggtagaataggtgagggggtgactaatttcatgagatatggggaatgggagcctaagaaaaagttttggccgggcgcggtgg

SEQ ID NO: 56 - DNA, 94 bp, Homo sapiens
tacaagcaagcaaacaaacagtttcaacccggagtgaggcccatctgagggggcatttgaagcatcaacaggagtgtaagaaaagaaagccctt

SEQ ID NO: 57 - DNA, 117 bp, Homo sapiens
cagcccatgaagtagatactaagtgactacagaatgctgattgacaacacagaaaagaaacgaggaggtacagaattccctttttctttctttctctgtgtttctttttctctcatc

SEQ ID NO: 58 - DNA, 235 bp, Homo sapiens
attcccttaattttaaattggcagcaaagagattagttgaaagatggggtgaaggggtagagaattccttttactcaaatcataaacattacagaaataaaaaaaacccggtcctttataattcccactccaggaaagaccaatgttgtcatattggcatatattcttccaggttatgtattcataactaacattgttttctatagaaatggaatctctctcatatgctggaggt

SEQ ID NO: 59 - DNA, 186 bp, Homo sapiens
caccatatctgtaccaattgtcaattgagattttaaatggccaagagtaatttttgtacatgggaaggaactcataaagctgcttgcatctctgttgatatttaatttattatggcagtaaattttaagcctagttgttattaagcatttaaccacatttctcaaatttatgtataaatctatcaa

SEQ ID NO: 60 - DNA, 618 bp, Homo sapiens
tatcaatttattttaaaatagaacactttcacttgtactttgattaatgttcagtgagcttattaatttgacatattaaatttcccatttaaacactatttataaaggtaatagaattttcttaagcattgtaaatttataaaagcatacagatttaacaaatcaaattctcttacatatttaaacactgtttataaacttcatttattaaattcccttaaagatgccaaatccacacattgctgtaactgatggtcccaggtgcttcattcccccaccaaggcaaactgatactgtactctgtaaatcaccttgacccattctcagccccgtcctgagcacttatagactgaatattcctgtaggagtcctcctgagcactgaaagggcattggttaggagcataataaataataaataaagaggtgatgaagagcctgaatagaattcctcatacagggcagagaagggcattccaggcagtgaatatcatacaacccaagttactaaattgtttgggaaaagtcacagtttacatctagcctcattcccctctcaaatcatgtaactgaatgtgagccagggacttagtgaagtcataagatctgtagctttaga

SEQ ID NO: 61 - DNA, 147 bp, Homo sapiens
aagcactatttgtgctttttaaaaatggtcctcttgttcacagtttaaggcctttggctgtagattttatttttaaatactgtatttatttttctgattacagtaataacacatggattatacaaattcaaatattaacaaatatat

SEQ ID NO: 62 - DNA, 142 bp, Homo sapiens
tatttataaaaccatatgctaatactttgtaacttttttttttcaattaaacatacatcttggacatctttttatgtcagtataattagaactgtctcattttttttctccttccttcctccctactatctttctgctgagt

SEQ ID NO: 63 - DNA, 39 bp, Homo sapiens
ggacaacttaccagcactcacagtggctaattattatta

SEQ ID NO: 64 - DNA, 278 bp, Homo sapiens
tgtgagtttgtaattaagttaaactcaattggaaacatatgtcaaattccatttctttcaaggaatggtaggactttcagcaaatgagtctaatctatttactatcctttgatcaaacattcaaaaccaatcattatgaatgttaaaaggaaactgcataacagaaccatagggaaaattaatgtcttgacttgcagcttgtcagagacagatgttttcataactgagttcatttcggtctccaaagtaaataggtttttttctagtaaataagaaat

SEQ ID NO: 65 - DNA, 200 bp, Homo sapiens
cccttttgacatatttgtgacagatatgttttcctaggttgttttggtcattgttctcttttcctgctgctttctggcctattactatgcatttttcagcatgtgcatttgttttctttgttgtcttttaggtgatactgtagctaacttcagttttcttagcccctatttctcctctcctgtcccacttagaattgctg

SEQ ID NO: 66 - DNA, 185 bp, Homo sapiens
cctgaggccccagaatgctttacacccaagtccatgcaagttatgaggcttctgctatgttcagttaggtggagcatcctgaaaaaaaatagtttatcaaagcatttccagcttcaactaaggcacagaattatgtgaatttgctagttgcttaatatttttctgctctcctgagatggtttgtc

SEQ ID NO: 67 - DNA, 150 bp, Homo sapiens
gctataaataaataaatggagatagtttgtcataaagctcatcataattgaaatgataaaaatcatatttaatagttttttggcataatgtatattaaaatgtgaaacatgataaaaataagttatatacattttatttcatttgttttt

SEQ ID NO: 68 - DNA, 73 bp, Homo sapiens
aattttatttattattacttttggggtgcagatattaataatcatgatcatgttcttcaaaataataagcact

SEQ ID NO: 69 - DNA, 232 bp, Homo sapiens
gcactgctttgtatttctacaggtaatttacacttaccagatatgtaagcagcaattctttggaaaaaaaaaataaaaccaggggattctagtaaattctcactggatactgtttaaatatgttggcctaaattgccacttacatttaagagatatttgccctgattaatatgcaaaagaacagttgtccttcagtcaaaatgcagatttgaactgctttatggtaaaacac

SEQ ID NO: 70 - DNA, 82 bp, Homo sapiens
ggctgcctgcattccttggctcagggtctcttcctctggcattcttctccaccctgacccctgcttttgttgtcacatctcc

SEQ ID NO: 71 - DNA, 239 bp, Homo sapiens
gttgtggaccctatttctgaaatttctaataatgaaaccaaagttggcattatatctctgcaaagggatggagaaagcattcttatttcaccgtactttagaccttggccaaaagctaacagcatttgaagacaaactctttagctacttgttttcttagaatttgggaagttttgaaatctaaagggttttgaataccttctaagatttcactctatataatacataatatctatcta

SEQ ID NO: 72 - DNA, 33 bp, Homo sapiens
ggcaacactcatttcttaagttattgctgctgc

SEQ ID NO: 73 - DNA, 63 bp, Homo sapiens
atccagaacatggcaacactgctaaagccttggctgtgcctgcacacacacacatgagctgtc

SEQ ID NO: 74 - DNA, 150 bp, Homo sapiens
acctaaaaagacttgaggaaacatattctagttaataatgtgcctcatttatatgatatagtcaagtgcaataaacatatactaaacctgtgcatttaagtcaaaaaaaggaaggtgggaaagaagaggtgctttaagtaaaattctcaa

SEQ ID NO: 75 - DNA, 56 bp, Homo sapiens
ggtgacaacaaatagcttgccagcaaggagtcaatcaggagtattgtgatatgtac

SEQ ID NO: 76 - DNA, 211 bp, Homo sapiens
tgagccactgagtctggcctttgtcctatttcttaaaaattatatttgctactaccatgactactactccagtgctttaccagcacttaaatacctccaatgtctgggacaattaggagtgaggcagacagggtaagcatttcaatcatgtcagaggcatcgttttcataaccagaacaataacgaatatttatgatgatttaacctaaac

SEQ ID NO: 77 - DNA, 45 bp, Homo sapiens
tcttcatgggaaataaatttattcttatatgtctcgggagacagg

SEQ ID NO: 78 - DNA, 144 bp, Homo sapiens
tgagacctatatataccaatatgaaaagctgcccaacatatactgctacatgacaaaagaaagttgtaagactgtatcttttattttgttgatatatagatatgagtatttgtatacaatatctggagacatatacaataattt

SEQ ID NO: 79 - DNA, 680 bp, Homo sapiens
gtggccaacaaactattaacaaggggcaggattatggagacttttctgttttgttaaatgttcatttaaaagtaataaacacattacacaagaaaaataacaaacgtaacaacaaaaagaataatacaaaatgaaaggcaagaaattaagtaatacattttacaaatattttcatggggaactattgaaaatttattgaaaacaacatgttttccaagaatttagaatggaaaagttgttccacctgcagctttctgattgagtagctggatgctgtgatctttcactcagttaccccctcttcatcctggttgatttccagctttcaataaagcttttcacctgacgcaggataatagcgagtgcatgtgtgctggtttgtttactgtgagtctctcagaggaaatcatgtgcatctgtctgtttacttttccgtggaacctagaaggtcacctctaaaaataatcttgctcggtgttagagtttctgtgacacagaggtacatacctcacatgctctccacagttagtgcgctaagccaggcatatctagttcccaaatgactcagatcagagaaggaggggaaggcagctgccagctaagatgtctagtgactgatttaagagcagatgcagaggaagccctttacaaaatgggacacactcatggctgcctttcta

SEQ ID NO: 80 - DNA, 387 bp, Homo sapiens
tccaaaggaaatattaggagaatttctgaaccagagcccatgctatggctatttgactttgcagtagacacatttggatgccttttcactacctcctttggccccgaagctcttgttaaaacaggtgcgcctgaggaactgcgtttatgcgtgaagaacactctccatttgcccctgacgtctgcctcactcttcccagattgaacctttattatcccatgctgggctgggacctcattatggaaggcctcgaaagccagcctgcggaggttgaacaagggagtaggatgatgagagttctgctgtaagagattaacccagcatcagtgtaagagacttgagagggaagaatgggtagagaaagagatcagttagaagtcttttatt

SEQ ID NO: 81 - DNA, 361 bp, Homo sapiens
aaaaaaaaaaaaaaaagaagcctgttgtccaagtcagaaacaatgaaagcctgagctaaagccacgagcaggagagaagggaatagaaagagataaattgaagaagcaaatctatgaaattgtacagctgattggatccaggatacaaaggagttccgtaggtcccagaagactcctagatgtgtgctggaaattgtagtgctgctgtggagatgtcacacactgggctctacctcgtcctcttatgcctcttcggggatctcatgccaacaactgttttgtcatctatcttcaattatttactgccattgattccttcccatgaggcctatttaagaatctccacattttagaacaaaat

SEQ ID NO: 82 - DNA, 91 bp, Homo sapiens
tagaacgaagaagggagcttaagtaggttgcaaagagggccagtggagagattgagaatggtgatgcaaccactttggaggagaggggaac

SEQ ID NO: 83 - DNA, 380 bp, Homo sapiens
tcagggtggctcgggactgttgcttttttgaaccatttgcgtgtatttctttgatgaaatttttaaagcgttttttccctgttttttaacatgtcaaaaagagcctttattactttagtagtagcctcttatgcttccttgccagacacttttggagaaggtgctccctgggccaacactttttgacccttctgagctttctgaagaagtgctgccttctggcctgtggctttctgggcaggaatcttccgggctggagccttcttgcccgcagtgatcatcttttttgctgggactttagcagcaggtgcttttctggtagaagctttcaggagagctgcctttcgaagcttcctaaactcattttttgtttgtttgtt

SEQ ID NO: 84 - DNA, 512 bp, Homo sapiens
tctaacttcattcttaattattcttttcctcattttctttgccttcatggctttaaaacaatcaaaatctgtcatcttggctttcctctctttggcttcaatcttcttggcttagtgtggctgcccattttgcattgaggtctacctgctgccaggcttgttggacatacctttggtgggtgctatgtgggaacttgaggatgaagtcagtgagctgcatgcatttgaaagacacggcctgtcccattacctgagtgcaaagtccatcagccagagccctgttttcatcagtaacatctacaactgcgaccagctttccagcataaggtccaaaggagacataggccacctggcaaacctccaggaagtgcttgaacatcatgtcggcagcgtttggcaagaaggaagttctttctttttttggtataatggggagagaagcctttaaaaagcctccctaaattcacatctccttatggctaccatttttttctcttcttccttgaaatata

SEQ ID NO: 85 - DNA, 185 bp, Homo sapiens
gtagctaacactgactgaggtattgttatatgccaggcattggcacataacattcattcatcatcttatttaatctttgaagtgagcttattgcaactagacatctttaatgaattgtctattcttactgtcctcatttgctcaccatccaatctcttctcaacccaccacaaactggcttttgc

SEQ ID NO: 86 - DNA, 286 bp, Homo sapiens
actggttacacttgccatggctttggttacacttgcgttttttttgtttgtttgtttgtttgtttttttaaatctacctcctggcttcttcacagttctcctctaaggtctttcttctgctgcccacctcctaaatgttggtgttcctcagatttcctgctctagcctgcatttcctctcattttatgtctcttaggatcatttatatattccccttgctcaagttatcacggatgacactcagacctctgtgtctatcccaaacagttttctcctgactgcgaac

SEQ ID NO: 87 - DNA, 136 bp, Homo sapiens
aagaccctatcccagcacttccacactactgtatttatccatatcttctctgtctgtcactgaactgcgaacctttcaaagacagacagtatgtaatccatcctggcagagagcttcaatctgttgaatgaatcat

SEQ ID NO: 88 - DNA, 798 bp, Homo sapiens
agttcttggcacaggaagggcacatgggcgcttgtagctacttgtgtattctcttccccaactcacagcaagtgagaacctgaatggtttgaagggaataaggatgaattcagaggtgggtcatgcaggcggtgagaccagttgggagctgtgaattgaacctgatgtgggagctggaggtgcaggtttgtaagctaacagtttaggggctctgagctgaggccttggagtaaatgagattgcccaagtgagactgtggcttggggaaggctcaggcctagggagcagtaaaaagatcggccttcgaaaaggcaggaggaggaagggtctgtagggtggcagaggcagccaggatgaggaggggaagaaataacagctcacacactgccaagaggtggagcagaaagtacccgtgggtttggagtgaatgaggtcattgatgtccttagaaagagggtgttgctgatagttttgtatgcttaatcatttgttctaggtcacaaaaaaaagagggggaccgtgtgggactgagagttccagagcaaaagccacctgaactgataagcagggaaggaagagctgaagagagcagcagcacaaatgccctgtaaattaacaaccacacggctcacaggggcaccccggcacccacacaccaggccctcccctgtccctccccatccccactgactcccgatccctccaaaggataccaaggaataacctggcctgggtggcaggaggatgctggggagggatctacaaaacatatacaaaagagtttggggtttttgtctg

SEQ ID NO: 89 - DNA, 171 bp, Homo sapiens
aactactttgctggggaggtcgttggggagtgggtggaagaaggggttcagaagccttagtctgggagtccaggcagaggcatgggaaggcctctgggaagttgaggaacctatttgtttacgtaactcacttccgaccttgcagggccaaggctggaaccatctagtgtg

SEQ ID NO: 90 - DNA, 150 bp, Homo sapiens
acgtggctcacattatattcttttggatggtcttgatctgaaggccgagttctggtattaacagaagttccacttagtggtggggttggagaggcctttccccaccttttactactccttttttttttttttttttttttgagacattgt

SEQ ID NO: 91 - DNA, 524 bp, Homo sapiens
tcagagattaattttaaaagagagcagaggtcatgtggatgcttcacataaaggagtgactcactgacattggattccaggcctctgggagggaaggatttggccttccaggaatctgtattgagagctatctattggtaggtacccctgatacccttacttcttagatatctaggattgtcccaatgtatatgttctgaccatgtaagtactcatgcttgtccaatcttgaatcccattttaagcttccaaaatgcgcatatgtagggaatgatcagttctgcttctgtattatgctgctctccttattcctgaaaatggtccttcaaccctcagcagaggttgcaggatgcctgcagctgcaaacctgtcttgctcatgctgcaaaacagagatgtcatcaccgggtgagaaactaaaacactgaagatggcactttccaaagtttctgctttctgaagcccacattataaggtcatgtgctaaaataccttatgtagtagccttgattctagagcaaatta

SEQ ID NO: 92 - DNA, 215 bp, Homo sapiens
ctcactctatattaactatcaatataaaataggtgtaggatacttctaaatgtgtgtcagaacttatttggtcacacgtgatagacagctgattccaattaaaatgtttattggaaacataccggacttcttacccaatattagaaaagattagaaaaatcaaacccaggagagctgggtacagctggaccttagagctctgatactgcaggcac

SEQ ID NO: 93 - DNA, 161 bp, Homo sapiens
actacaggcactttctgtctcctctctgtgcatctgtgtgtgttggtttctttctcattcactgcagatgggagtcctcatatggccagaaaccaacaactaccaaggctatctcttgcaacttcctgcactagagagatgttcttctcgactatagttta

SEQ ID NO: 94 - DNA, 201 bp, Homo sapiens
gccaggggaaggactatgagtggcccagcctgggcattcatccttatacaagttcaactttgaccatgggaatcaggacatataagagcatgattgctcctgttggaatcccgtggttgcggttggggatttgggtaacaagttcccaaacataagggagggtgctgagtggccgcttgccgtactcagtcattggctggg

SEQ ID NO: 95 - DNA, 103 bp, Homo sapiens
ataccacttgggatgcggttctccttgccagctgggagcacgcggtccagtccccaaacagagcttgttgtttctgactgccttcaggaccaactgtgctgat

SEQ ID NO: 96 - DNA, 73 bp, Homo sapiens
ctagaggagtgccatgctgggctgtgctcagacactggctgggagctttctgggaagaaaatggatgtggtgt

SEQ ID NO: 97 - DNA, 107 bp, Homo sapiens
gagtctctgcctttggcttccaaatagccttaataaagaaacttaattaggattttgaaacccaaaccctaggtggggatagtctcatactgaaaaaacaaatttgt

SEQ ID NO: 98 - DNA, 40 bp, Homo sapiens
ctggtgatatacccaaaggatcttagaaatatataagcca

SEQ ID NO: 99 - DNA, 330 bp, Homo sapiens
gacacctaacctcctaaacattataaaccaggttatgcgatattttagggtagggaattaaagcttactcatccatgtccacccattgtctttcacattacctaggatatgagatagaagttccatttgtattagttggccaaaaaggaattaattcatgaataataaatgaatgaaaaaatgaatgctaggtgagtcattgatatgactattgatattttaaccagcttacccttttgtatttaagtaatatagtgcctttcacttaaaatccaaagggtaagctggttaaaatatcaatagtcaagactttgtaaaatattttttttc

SEQ ID NO: 100 - DNA, 157 bp, Homo sapiens
gagtagtatgggctggctacagaattggcaacgtcatttgcaatcatgtttcagctgccatttacaaggtgatgatccatgaatccttacctctttcatgagtttcaggcaaatattttaaacagcaaacttgatggtgcgaccaaaatggtgaaac

SEQ ID NO: 101 - DNA, 136 bp, Homo sapiens
gagattgagctggaaggataaaatatagatagaaaatctattctgggtcctttgaacaattattgagctactatgttgaatttattaatgaaagcgattccttgtcatttaatatttttatctccatgggctgcca

SEQ ID NO: 102 - DNA, 1023 bp, Homo sapiens
cagccaagcaaaccttttttttgtggggcggggggatgtaatgctaaattaattgcagagcaattaatttgaggaagagatgaaaacttcattctttgtgaaggggtcactgtgctggtcagatacctgagcaaacaggccaggcctccaggcaattagatcaagtacatttctcattgcccagaatgtggacctgctattggagaggacacctgtcttcctgaggtcagtggctccagcattggattgagctgtaaccagatctgggtacagatgctgccaaaacagggatatcccaaggtgctattactggatgctaattttggataaatacctccttgatgctttaagtctttcaaaatgaagattgcatgctctagtaaatcataaatattattgaagtttccattttcagcgaatagttaaactctattttttgtagttgggatatgcaatacacatgctggcatttttatacttacattgaggttcggaattcagtattttacaaggccctgggaacttgtttgcaaagtaaagtgttctgaaaagttaccctggtgcaatatgatcgctcccttcggagaacttgcaagtaaatttagttagttaaagcctctgccagcatgcttctagcccagagaataaaaacgatatctccagttgccagttgcttttatctgttgcttctcctgaagcctaatttgaagaaatttcgttttgctgcaggtttacgtttctgacttatcttacccctggacttttctccaactgtttaagtctcttgagctttcgaggaactcagtggttcatgatatagtgccttacactcaaaatacaaaagggtaagctggttaaaacatctataatcaagacattgcaaagcttttttttcttcttcttaacaggaacggtattaatcgaccttattaattaaatggggaggctaaatcttaataatcttccattattaaactaaaatgtggccaaatgctttctactatcatgccaacatgaaatgac

SEQ ID NO: 103 - DNA, 507 bp, Homo sapiens
gaagtgacttttcttgctttcagcttaactagctagaaacttcaacaaagcttaagtcttaaactgagatggtttccttttgacctgatagggcagataatggagaaatgaaaaggaaggaggccaatttattcatccgagtgaccaagaggattggagctttagggaaagatttccccagagatgatagggtgccatttacagctctctaaaaaattataagggaatttgatttttaatgcttttgcaatcttagtgtagtggctttttatagccctgagctgtgtgtctaaatgaatatcccaacgtcaaagtgggtttctatagatcaccccttcctgctgtttccaaaatggtttctttcttagtttgcagacttaggatttcatttgagaacaatgtgaaatgcctctgactagttgtgagcaaagctggtcacctgatgccttcaaagttagtcaagggcaagtgcagcctggttggagtttggcatcttggaatatcgat

SEQ ID NO: 104 - DNA, 359 bp, Homo sapiens
ttgagtgtaacagtgcccagcagatagtaaatgattgttaaatcttattagctaaaaagaaaacaagcattggcagcagtggaacattttctgaagtaggcctggtggctaaaacaacgtataaaatacttgtttcactcttccctggctggctggggagaaaggatatatccacacgtatgtttatgtaaacatatataataagtgatgtggcacatgtgtgagaggacgaggagtcaaggaagtcctgtcaaggagacagacaggagcttggccttagaggagaagcaggagccagatgagctgaccacaggcagagggcatgctcagggctgtcatagaaagtcttctttaattaa

SEQ ID NO: 105 - DNA, 296 bp, Homo sapiens
gactgatgttttaccttaactgaatattttcagtttggtcatttgaaaataaaaatttgttgctagtttaaaaatacttattttctttaactgaactaaatactttgtcaagtgcagaatggaaataatctgccacaacaaaataaaaaactatttatgcacctatatgtgcctagttttctttggggataatataattagatatgattcttggctttaagatcagtaaaaactcagccatccaagtttatatatagtttaataaatcatacttaaggaaaggtgtgtggttcaat

SEQ ID NO: 106 - DNA, 387 bp, Homo sapiens
cttcatagacagtctattttatacataacatattgtgagaacaagctatttggtaacattttccaaataactcttctctacaggcaataaaggtatttgatgctctactgtaaccagaaactatatcaaaagacagtaaaaaagtaaaaataaaaacctcaaaacactgacatactatgagtagaactactagaatgtctcctttggaatcctccttattcatatattcaaaaaattaaaatgtttcctgctgtgtgccatgtgcgatgtgttaggaactgtatgtactaaaccgttttgtttcctgctgtcatggagaatgacagataataaaaaagtaagcaagtagatcactgtataattacacattgatccatttactcattc

SEQ ID NO: 107 - DNA, 69 bp, Homo sapiens
agcattgattaggaattgcacttggccacatgtaatggaatctgctgatgatagccttactatattggg

SEQ ID NO: 108 - DNA, 815 bp, Homo sapiens
gcagacatttctatgatgataatgatatgaactgtcatatttccctagtggaccagtgactgtcatgaaaggtctttaaaagtacctaattgatggaatcaaacacttactgaacataatgaattttccatgttctacctaataaaagcctaattgtccatgttcctgttgaacaaaagagttttttctctatactgctcagggaagaacagtttagtaatctttaactgctagagaaatgtattcatggagactaaagtattatgcaaaaatgaaaagtcagaaaatccaggaacaagctgtaccacatgtacagaatctttggatttttgagaaacggggaaaaaattgaagaagtgtgtatttgtgtgtgaagggcacaaacgtaaggacaagttggaatagagcaaaattataataatcatatattctggaatacttttgtaaagccaaaattatctttcagtacttttttagtccatcaggaatggatctggaatgtctaaattggtgtgtgtgtatataaattactgcatcttcttacatcctaacaaattccaattcaacctgaacttgagatgagaagtctgaaagtaccttataattaaagctctaggcatattcaactgtgtcttgaggagatacattatctgagtttgtggggagttatgtccccttgacaaaatctaccgtgtttcttaaattgagaaatccaattatctgattgtttttaaatgagtgtattgaagattaaaaagggataaagagaaaaacagaatcaatatttagcttttactgacaatataaaagatgat

SEQ ID NO: 109 - DNA, 435 bp, Homo sapiens
ataatgaacttgtttcatttaattattttttcagaagtaatcttaggtcactttttcttgtgctacattaattattttataagtacacatcttatagccaaagcagttatgaaaggagataccaatatagttaaactgtatttgggagatttttttaaaagaatgtttaaattttaatgtaactgctccccattgctgctaaggcagatgcagtaagaaatcactggaaaaaggcagggttcaatcattccatagctcaagtccaagcaacatggaaaatcagaagggaaaatgggtgtgacaaacactagaattttttaaaatgactttgtattgtgctatttaaaatgctttatctacaaaagacctacaccctccctgtctaatggagtaatttctacttcatttctttcatctaaaatattgatacccaat

SEQ ID NO: 110 - DNA, 828 bp, Homo sapiens
ccctgtgggtgatctcacaagtctctgggttgatgacaagtgcttagaagtgtaaaatcaagtctgcctggaatttttgttcacaccttttattgaagagagggttacctcccagacactcttggatagatacctttcccaccactaccaccatgtctgaataatctaacccccaagaaatagcaaaaatattcaaggggagagaggtcagggttatgtagagaaattacacctcaaaccagactgttagtacctaaggtatttaaacctcctggtagatatgacagtgtgcaatgtgaaatttctattatcagaaattttattcatgtatctcttctcaaaatacacctaagttcatcatctcatttggttcttacaatttttaaagtccccacatttagataagactgaatcatgggaaaagaagtatctgttgggaagttaaaattccctaggaaacagtgaacttaaagcctagagttagtattcaaatttgctttgacacggccttgatggctcaggatattgccttactataatctgtgctattaacatagcacagaagcaaaatatttaaaaccacaataaaatatctcaattatggggcagataaatgtaacttgagacatcacaaggtaccattgcattctagcattccttggagcaattggttcactgggcactctcccttgtgctgaaaggggcccaggcagaatgattccaatgtctggatatgtttggaattgctttcttgaggcaatctacctggggcttttgtcctggttgttgggtgagttccttaatgcctctctaccttgcagctgctag

SEQ ID NO: 111 - DNA, 34 bp, Homo sapiens
gtatctatgaaacaaaaagacactcacagtgagg

SEQ ID NO: 112 - DNA, 225 bp, Homo sapiens
tatatatataaattttgttcctctcttatgtactttggcaaaggcactcattatttgtcccaatttttttcaactgcaaagttgtaataatgatccctgcctccttctctttactagtaataatgacacaatacaaaaggtaaaaatattgacagtatattaagctgtttaaacaaaaaatatatactacataaaaaagaatagcatcagacctaataccattac

SEQ ID NO: 113 - DNA, 1529 bp, Homo sapiens
atattgctagtgtaagttcttcctatcaactgtgaattcatgaaggtaaacttctgatggcaaatgtaggactcactttatatatattgataaatatcagactctattcaataccttggagatgtcatctttttgcagaggcaatgtgccataagaaatttttgtcttctctttgttttttcaatcagtgcacaatacacttcttgttactgaaagacaccagtagggaggtcaatataattaaaagattgatcttctggaaacaatgcttaataacaggcatgaaaaagggagagtgattttgcattttcaaacactgtcctcaagttaatttaacctgagctgtttgtgagccatctaaaaagtctaggatcaatatgtccaggctgaaatcaatggaccaaagagaaaaggagacaaactccaattggctagttcattcaggtcggtgacagccttgtgaaagacacttggtggaacatccatttcatatgctccagatgctaacagcttagatataaagggcaattgttgtattttgcttgttctctaaagtagaaatcaattatatatgtttacttgcagatacacataaacaaacacatttttatgttaaaaagtaaaaaaaagagtggttctgagaaccttcttttttattccaaaatctctaaacagaaacaaacaaacaaacaaatagaccttcaataatcatctactgcattggttttcaaacttttgtcacctaaggatcttcggaacatcacatttttattatcacattttgatctttttatttatgttcttatggttcttggccagtagtcctctaaacttgattttttttccaagccaatttctcttttgttctatcagtctctaatagttattttttgtcagaaactatttcagttcaacattcactgagagctgagcatgagcaaagcctggcataagatgttctcccaatgttgtaacctctgggacatatatattctctcttcttccttaacaggaatttgtatgaaagatgccaaaagacttacacagtacttccaggttattatggattgttaggtctaacacaaaccataaatgaatgtcaaaaggaatacaaaaacagaggtcaacagaatttcctgaatggtcatatgatccagtttgcaggaaatttgaaatttttttgcttctgtaagttattcaagcccataataacctacacagaaatcaagtaaaatactcctgacccaaatatttcagtgattttttttctaggtcattgtaattgtataaacataaataatattgtatgcaattattcaatgtaaaaaacacagcacaatcatgagggtggatgcaaatttatttcatactcattttgtattcacataactttcactaaagcaaaaacatttattgttcatgtgggatatatcacgaacattagaacacattatccaactaacttatttatgtggaaatttacatatgtcatcttcactttcaattagcatctaagaaatttttgagga

SEQ ID NO: 114 - DNA, 813 bp, Homo sapiens
ttattttttagaaaagaagcttaccagttagttgcaagcagaaacacgaagaatggcatggcaaaaaaaggtaaattcgacttttctgattgaattatatgttggaaaatacaaaaattaaacttttctactattacatttttcacaaaaatatagatgagaaagccatttagggacagaatgaactctacatagaggaatggaatgggttgttgggtgattatacaactttaaacaatttaaccactgacaatattaaaattaatatttagcaaataactctctctgaatctagtggaatatgtgagaaatatgaggtacgccctccataagcttcataaaataaatattagtaacaaagtgaatgaaataattaaataattacagtatgggccagagggttctgtttagttggcctttcttgtgatgctgttcctaaatatcctaaaaagcttagcagctaattattcaccaaaaataaccccaaatcaaattcaaaattttgactttcttggacaaagtacagagagtcaaaaacccaagtagacaatgttcttattttttattaaaggtaaaactctcaaacctatttatgttgctattatgatataaaatgttacatattctttacaggaatctggtctgtgaaaatctagttattagtttcacaaatgatttcccataaaattcctttaaatagtatactcttataacacatttaaaattgattatcgccacaaagcttaattcacaaagaatagttaatatatgatatatagccgttgttttatgtatatctattttctcaatatt

SEQ ID NO: 115 - DNA, 586 bp, Homo sapiens
aaattttaaaatatcaggggtccttcctattgctaataacatttctttgtgaactgatatacagtttcaaatcccttgttaatgtttcttcttattttaggattttaattccagactagacatactgtgaaatatttaattcaattccttcattggattacaactatctgtaaaaaatcatatagataaatcttctctcatatttaataatctactgtttatactatattttctgagttttcagtccattgtttcttttcagtaatgattatcttcagatattaccgagtacaaaacttccagtatctaaattgtcacctgatctggtaaaatatctgagtttaaaaataaaaaactcctcatgaaactcatctccaataaaattaatttttcatagttacatgtttttctattatactgttccaactctatttatacgcattctctaggtgcttatgctcttcctgataccacagtacctgtgcactttgatatgtatgtgatctgtgatccttgagcactcagaggaatgttcaacatagttaaaatcattctcagaaataaaagatgtcagaaattcctttct

SEQ ID NO: 116 - DNA, 1194 bp, Homo sapiens
cacacattaaactatgagaaagaaaaaagaaaaaaaagaaatacctttctagtagtcctacttttcttcaaaatggctcaatatattatcacatatggtatctcaattgcactctcaattttactgttacagatctaacagatatgaggaagatcttattcattgtttaccataaggaaaatcgtaacaaaagattttgagcaacacaatacaagttttaaggcatttggataatcttatttattatattcaacttctcttgactcagtactaatgtataggtttgtattgtgtttttataatcaaaaagcaaactatttttccaaaatgtattccacataatctaataaaatgaacatgtgcctaattacagaaaccaccaatttgaaaccatgacattcctgggcattcacggtgattctgccttgtgattttagttctttccttccttgagaagtgggatttctgggctgtccaggaattagagtgtctgtattctacatgataattagcatgcccaattcttaatcacttggctttcaattgtgacaggactgacagaatgaagaccctcgagttattagcaagaagatgttagattaaatctttcctgtatcacccatgagtggaagtcaaatttatctcagagctcatattcaatacatccttaattttcccatccttcttaggcttctccaaaatcaacttcctttttgtactgtgcccaccatattccaaccaatccattattttcaggcgcccataaaaaatttatggcaggaatgttgaggcatttatttcatcaagttagtacagcccagtttgtaaggttcatagtattttctttctcttctctgttttctctccctttagatattgtaatttccacttgggtgacagatctctgtattagactctttaccttacttctttcctggaatactaagccaagtgataacatttagttacttttcttaactatgagaaattaaagtaattttatgtttggatctttggattctttgtccacttcacctattttgatgactaagtttcatttcattcaacataagacatgtgaatcatattcatactttttaccttagtacaatctgtgacattctgacaaagacagggaaaaaaattcctgcgtttccaatcactttttgggaagagagtgctttgtctcaacag

SEQ ID NO: 117 - DNA, 286 bp, Homo sapiens
tgaaggcttagctgaaaaagttgaaaggaaaattttctaaggcttgcaatatatcatttttaaaagtttttttcttattttttaagataaaaaaacccgccttcactttagataagttgtaaaaccttgaaaatataaatagattgaaactcaccaataatgttactatctgaaggaaaactttttccataaatatattcatttatatttacatagttgacatcattaaaattataactcaatttcctattaacactatcaatttctatttatatcaaatatatta

SEQ ID NO: 118 - DNA, 452 bp, Homo sapiens
ctttgttttcagttttactaagaaatttttcgttcactttcctgcatgatattttaaacatacttgtccttcttacgcctttaatttttgcactatctcaaatcactcatcccttactgtgtccttaggtcagtgggtttttagccttatgcactagagaaaacttctcgagataagtacttaaatcataattagccatgtgttcgtcaatattctcttctactggggtagaaaacaatttttcaggttttcccaagaactgatgctgccaacttctgtgatgctacagagaatgacagctcactataataaagccttataagttaaaaggttgattcaattcaattccatttcttcttccttataattgctggaaatcccactcttccctggttaagtcgctaagaaaaaataaacgtaattgcctacatgctactttactttattttaca

SEQ ID NO: 119 - DNA, 1107 bp, Homo sapiens
ttgtcctcttgggaagaggcataataaaacctatataaaataattatattctcaatcataaatgaggtgctcacaactttcttggttgctataattaaggcaagataagaaattagtttcaaaagacttatttttttaaaaaaagaagagaaacaacaacaaataaaaaacagagccacctccaagtttaacccagttcttatttcctttgaattttcttccaaaattatatattatgccatcagagcctagtggtgatgcatgcattgtggacaactgccttcaaacatatcccaggatgccatcttagcacagcagtagtataaatgacctaggaaagacacactatacagtgccagtctatgggctttctaaagcaggaagagtggtgagcattcgttattgattacatttatttaatactcccatggtgtcaaaatttggattcaggaagcaataaagcgaatgaaactggaaagcctaagcttgaaaatccaagtagatccacaaggtaaggcaaaagccaggtgtcagaatgtggaataaggaaaggagtgaactatttcagataggagcgctcagagataagtgaccaaatgagggtcagaggacagatgagcgtactcagatgacatatgcagaatgaccatgagtcagcagacaaaacacacagagatctaagcaactgtctactccagcaaggcaaccaaaggcagcccatctgaaggcaagttgtagagcacccagaagtcatgtgtgtgttagaaaagcctagcaacagttctcacaattgtgatcagttggagaaaatattattcctaaaactgccccttagggagaaggctgtatttgcttgaaaggcaagcagtgacaagtgtttttggggaaaaaaagctcaaatattaaaggcaccgatagtgatcaaaattttagaggaaggaatgaatccaattctacccgaggaacattaaaggaatgtttttctcctgagaaggagagaaaataaaaatagttagaagaaaggagagttagggaaggaggagaaacaatatgcagggctcaattaaaagccttttcatagacatggagtcaatccaaatgcccatc

SEQ ID NO: 120 - DNA, 1188 bp, Homo sapiens
taatcctttccaaaactgcttctgtaaaccttcaacatttttctcatgaagtttatgtgtgagtatgttttttaaaaaaatcaaatcctgttaaagagatgagtttcaaatctgcatggagctagggtgagatcagggcagtgtgcaaagtaggggttaaaaatggaggtaacaaaggggagataagtactagggatctttcaaccatcacagtgaaaacttttagtctgttgccagctacagtctgatgagcagtttaaattctaatgtactgccaggttagacacaaaaattgttccagggccagaagttggtttgagcccataggggcagagtggaatggtttgttatgttaggattaaaagaattcagacaaggggtcaaattcatagcacacatgagtcaaaacgggcatgtggaatcagtgtaaatgccaaacactgccttaaaagataagcaaggatgacgttaacaataatgtgtacaaatatataatatgggttatttttaaagttagcctaattaagatttttgaaacaattttctttgttacatttgttttatgctaaagattttccacataatctgaatgaaggtattaaagagaaattgtgaaggagtgcatgatggaaaaattgaaaaccagcaacacaaaacaaactctgaaaagacaggcagagagagagtgttaggagataatggagagagaccagatgagaagaggtgggccaagcaaactgcaacatccaacacatccagccagattagccttctcgcagatttaattttgccatatttccatgtttgcatgcttttaataagggctataaataacctttaatatggttaggttgaaaaatagggaggaaatgaaaggtaggatttaacttaaagtcatattttattgaacgattttgtaatcaccagatacctttcctgtattgtaaaaagcaaacaaacaaacaaagattaggaccatcttcctagtcctgtgagtagcatttgtcatgaccaatcagctgcttctttgcacttttctttcctctctttgtatattgatcttctgattgtctcgctttttgtcctgactctcaactctgtgtgttttccagcccgattttaacatgagtattcctaaaagttctcgccatggacttatctcttctcaaactatactttctattgaga

SEQ ID NO: 121 - DNA, 1038 bp, Homo sapiens
ctttggccttgctatgatgatgcttagaaaaaggttacatccattcctgtatcttcaaattctggccatcctgagaataatttttgattctgtttttcctccaattcttcacctgtaactttactcctgcagtgataaattcctgttgggtattgctacctgatcattctgccagcacctccactgaacataaccaaatctgaagtcagtcctcggtttttttttcctctgattattcttctgacactattctctttttgcttttttgtttttaatgatatgacagtctttccactaatcgacccttaaaatttcttggtcaacttacatatcttattcttcaacttccacatctcatctgcctttaagttctagcttcctttcacaaatgctcgtcatatgcattcactttttctatttcctcttcactgcctaaatccagacactcatcattgtttatctgaattagtccacattatctgtgaactgatatccttacttctatcatctcttcgacgcatctgcatgagcagcacatgttaaaactgcgctaatcattccttgctcaaattacatttaaaagttgtcatatttaagagtactttaaaattcattagtttgatttttgtattactttatttttctttttagaaattgtatgtatttaaatatgctttatcatctacccacaagctatgtctccatatttgtcttccatgacaattaaagccttctctgctccagtcatgtccacagctcagagatccccaatcatgcctaggtttctcaccaccatgttttgctaactggaatacatttctcccttatttcagcttatcaaaatttttcccaacatttgagacccaatccaaattccttttctgcatgaagcttttctgttcccctggtacagtagatccagcatttctttcctttttccaatcctagcacttatttagaattgataaaaagctgtcatgctatgtaccagaaagcacaaacaatatactttaaaaagggttggatatcataggactg

SEQ ID NO: 122 - DNA, 924 bp, Homo sapiens
tattgccaatttctatgtttcaccacagcaaaaattattataaacccatcagcggtcagtaatatatttgccttatgtggcaagctgtaagaaatatattcgaagatttaacatatacacagaaatacactcacatatgcatattaactgcagaatatttggaagaatacagaaaaacagaagaatgaagatcacccaaggagaaagccttttgtcatatttatgtatttctttaggaattccctctatattatgtataggtcatatttatacatatgtagattatatatatataaacacttgcttacaaaatagaaaaacggtaatgtttctgtcaatttctacttgatataaaatctggtgctactcttatttaagtgcaactgtctatataatgaccttttctttgcaatgttgtttccagattcttgtggggcttccaaaataatataaaagtctcctcaccttctttcaggaagaatcacagaagcttagaagtgaagtagacaatgatttaactttcagtggcttcttatcattgtgttgactttatttggtgaagacatgaggttcagcacaacctgtattagaagggtctctctcatattaacgacatatgatgcaccacccgggttaacagaaacaaaacttcaaaagcgtttcagaagaggaagaaactgtaactctgtcacctgaggctctgcatacccttgaacatctcttacttctttcctgaggataaaaataatggtaattccaaggcgataagtaaaatgatccatctttgaaactttgactcaagaatagaaactcttttatctgattctcttctcacatctaagaggaattcatattttcaaatttttcacctgctaacggtgaaaaaggcacattatcctagtagggataggggagtttaaagca

SEQ ID NO: 123 - DNA, 236 bp, Homo sapiens
agtactgatacaaatgggacacctgcctcacactgtatacagaaattaaacccatatctgttgaacatcagcgctgtcacttaccattatactacactgttggtcacttttttcatacacttctattgccagtaataataacaaggaagaacaaatttggatacactttcacatgggatcttactattagcaaattctttttctcttgacattttggagatggttttatgtttgta

SEQ ID NO: 124 - DNA, 31 bp, Homo sapiens
gctctgctttttggactacacctgacctgct

SEQ ID NO: 125 - DNA, 83 bp, Homo sapiens
taatcagctttctgttcttgcaaatgaagacatatgtgtttagagaaactagaatatttctgttgaaaagtattacatttttt

SEQ ID NO: 126 - DNA, 91 bp, Homo sapiens
ttttctgatatatgtttcaaaaaccacaagatttagttttcaatgtagttcttgttatgatgtaatcagcattcttattttgccttatcat

SEQ ID NO: 127 - DNA, 238 bp, Homo sapiens
tttatatttgaggccgtttcttggttgaatttgtatttgaatatcttttctgagtatagtctttttggatcatattttattttccataaactaaatagatgcttctctggtatattctgccactgaatgctgtggtgaagttatctagaaccagcttaattccctacccttgcttgtttatacataagttttacctagaagacggagagattcattcataataacaagaatatacact

SEQ ID NO: 128 - DNA, 230 bp, Homo sapiens
tgggttcctctctgagttacagtctgtgagcagggttttatgctgtgtgcattcctctgtagcatgagaggtgaagcacgtgtgtagaagtgggaccttctgaggcagtgtgcccccttggagatggggatacaggtgtgcatttaagtgccaattctatcatttgccagcagtgtggccacaggtaaattatttaactgtgctgaatcccaacttccccattagtaaag

SEQ ID NO: 129 - DNA, 529 bp, Homo sapiens
tggatctgcagtctgtgtcagagcatagttaccactatcattatcatctattctgccgctgcttcttagctgttgttaaatgttgtacattgagtatgctctacatagtcaagtgtgcatcattttgccaggataggtacccttgacctttgaggctttctgccaatctcgtgtggggttctggagtattcctgctcctcagacatgcagatatgtgtgcttcctttctagttgctctagttcttcaccagacatttccattcctttcaaatcaggaaagagaaatgctagtagcacccacttatatcccttctctaaagacttggggatgttagtgagagtgtttgagattctgtcaactcaaaaatgtaacatcataaaagtgaaaacaggattcatttctgtgggacccaaatcatctgtttcattccttggtcatgttgaagtttataaactttgcttgtgatcttcattgtctattgttctttttgttttagttatgttttgttcctgcttgtagaagatttac

SEQ ID NO: 130 - DNA, 156 bp, Homo sapiens
cagtttaccttttattttttagttatgccttgtacagaaggctttctttcattctaggattaaaatatattgttttttatgccatttttatattttgataatgttcagtctttaaattatctggaatttgttttgttgaggacagttaaagacata

SEQ ID NO: 131 - DNA, 383 bp, Homo sapiens
tagtatcggcacactgatatatgtctaaatgatcatagattcgtcatatgagaaaaccataatcatgtataattatcatatattgtaaaaataagttatgactattacgtgaagtatcatatattgtatgaaataaattctcttattttcagaattttttcatttttgtgtgtatgtatttggtctttcaaatgatgtcagatttcctgttgaggtttttactgggctttctttgtaatttaaaattatttcttattcctttagtatatgacattctgtttctttaggctattacattcttcagtacagtttatggttatattcacataggtcttacccatcacttattgatatgggacgggggaagggaagtggtaggtaga

SEQ ID NO: 132 - DNA, 236 bp, Homo sapiens
acgggttttctagttttttctttatggatatattatctgttctattagctttgtgagacttctctttctccccatatatatgtgggggggatatatatatgtataatcacacaaccacatttgtatatataaatagtagctgcaaatttaacttagattacttttgtttccttgttttattttttatttcatgtccttttgttgctgttattgatattatagtaacgtataacatg

SEQ ID NO: 133 - DNA, 232 bp, Homo sapiens
tttaacttctttatttagatacgagaaactgagtgatttaaccaaggtagaacaattaccaaaaagaaatgacatggacttaaaaattaataaattcattttcagaacttaaaactttaaaccactaccctttacaaatatttgttcacctgattctactaggtattttgtttgcaatagcctggcagtgtggaggaaggtaggcaatgattcctggagctgtacaccggca

SEQ ID NO: 134 - DNA, 56 bp, Homo sapiens
aagggaacctctcttaaccatgggactacctagatttgtaaatcagtgctcactgg

SEQ ID NO: 135 - DNA, 2414 bp, Homo sapiens
acacccatagctgtggtctggttgtggaggttatctgccactcctggggtctgttactacttgggccactgtacgtatgcttgatgctttcttccagggatgcttatccttgctgtttcttattaagcccaagtcagggaaagagggcttaattgctatacatatattaaacattccaattgttgcttcttactgctgtacttcacttgtgctacttccaaactaatctctatctttacagcagtccacttgcgggtgatttagcaggttgttctggtttcacctgtatgtctgcatcatccaatttgttttctacttttgggtgatatcaactattcttctgcagatgacagtgtatcatgttttcctacattgctatggattaatcctctaactttctctttattctctagatctttatttccatctctaggtaccatctatttgtattttttgtaatcacatgggacttgggcagaactcagtgcttgattctctatcttgatctagtcagtctttcttttcaaagtagaattgtgaactttgaaaaaaaatacctatgagctttatacccttaacagaatatagattatgttttattgagttgcatttgtatcgtatttgcttatttcataggcactgaaatctttccagtcttttttggtataggttcttcttatgaatacccttaaaaagtggaagctagttctattagccctcagtctcaacaatagcataaattttgtaattatgtcattatctgtgaatattacatcatcgttgaggttcatgtcttctattttaataacattctgcaaactctttatcacagagctataatcctggcttatttttatatcttctatcataggtctcaaagagcttctataaactctagctacatctcaaggttattaatcttatttggacacgaaggacttgacagtcacaggttaaaagcagtgtgtgagcagcaggaactgagtccacacatcctaattcctgtccagtgccccatttactgcttaatctttcacaggtcctgtctgaggcatgccacatttatttcacagctgcagagcctaaaacagtgtaataaacagaggtacaaaataatgatccaaaattctaatcacaaattacaatatttaattatttgcttcttttcaatatatcccttaattaattgaatctaatattcctttttgacaagccagctcttttcattactttttaacaaataactactaaataactctgctggtctaagaacaattggcatagatttgaaagcacacttgcaatgaattatttccaaattgtaaatgaattctctttacgtctttctctttacctgacccccaaaacataaactctgctttcttatattttaagctgtcagctttgaccccatgttcaatttggtggggggttgtttgttgtcattgttcctccgctcatttttgaactgagaaataagatcatttttaaaaatcagatacttatgaaaattcatcaaataagatctatcttaaaatttagtatatgaaagatttgatgttgcctttcacctactgtgataaatactgggaagattaggagaaggtgacctaagtgtaccattttctctcttctattaattccattcaactacacacacagagaggtggcagatgacaggtaaagctgagagcagagagaatttgccatgccttcacaggttacgctgtactatgtgagtgagaacaatggaaagaagaaataatgggaatatctggacttccagaattctgaataaaataatgattagtctgtgttatgtcattccaaagaaaaaaaaaacaggagggcagtgtatattatgcaccaaccatgtgataaggttttcaaaactttaaaaatcattttcatgattttcttctttttgcagaaataaagaatcctatagtcttaaaaagaaagcagcactgggaacagcttttttttttttcaaaacttttatcattgaaataaacgctaagaaaaatgagacacaggaaaatgccattacagagaagagcggagttaagtatggctatgatcatacttgagaaattcagttatatcaaactgaaaatacattagccgtgttgattagatacagaggacgtgaagtaggtctaatacagccctagattcttttatttaaaattttagcaggtattggtaacaggttgtttttccctgtttgaattgttttcccttacaattaagaaggttatatcttaattgtaaacatggctcttttccaaatttctgtcaatattttctagcatctcatgtccagaactggacctcatgattatttttaaattattctaaatacaaggatagagttttgtttcttttgtttttgtcttctaagcatatttgag

SEQ ID NO: 136 - DNA, 747 bp, Homo sapiens
tttctgtaattttgacttcctcaatatttttaatatttatatcatatttcaccatttttatgattgcctaaaatattttctataaataataagattatcagtattttcaaggttgagtaaataggctaattatatatctttatatttgtattgctaaggtctggttttatggctcgtcaaaattcagtattaagagatagatgacactcaggaaaaaaaacagataaaaataagaacaaaatagtaattattgatgactttaaattgtgttcaactatgtgtgttctatttaggtaaatagcaattattgatataataccacatccacttagtaattaatattttttcttttggttttggccacataggaaattttacaaaccatggaaacagaactctcaagtttgcacttaaagtaattaatctgcaactcatatccatattaaaatgagtctgatattattgacccacttcccctgagccagctttcccctttatcttgttcagtctggcttcctccctaaataaaatacttaaaccacagttactaaggtctttaaatatcttacataatgtctctaaaatctatccctgtgtcatgtacatattccagtggtttacactctactgttgcctaagtcctgccactttaataagttaatccccagaatccagaacatatacatacccattcacacacattatgcatttttatcatattttctgggctatgaggtcctaatattg

SEQ ID NO: 137 - DNA, 683 bp, Homo sapiens
cacatataagactggttctcttaatggtcttaaagtatctctgaggaggaagatctacattgttccttcttcctgttcataaggatagaaggacatgctccctggaagttctctcttaattgtaaatatgactcttttccaaatttctgccaatgttttctagcatctcatcgccagaataggaccacatgattatttctgaatcatttcaaagagaatagagctttgttccttttgtttttttgtcttctaagtatatttgagtttacaatttttaaattttgaacattctgtgatttgtacttcctcatttaaaaaaatttatatcatatttcaccatttttaattgtcaatatataattttctataaataatatgataagtaatgaaagggctgatttataggggtggttctttgttttataagtaaatgagaaaaatgaatgatttaaaaaaattaagttcaaggatggtaaatgcagaagttaaagtacctgcttatagaaactggtgatactttgaagttttattgtggaatgagaaacggatatgacaaaacctattttaatgaagaataagagatttgataattagccaatttaataatactggaactaagaggagtcccttgacactggaaagatctgtttaaaacaaataaaggatgcgcccccttaaacttc

SEQ ID NO: 138 - DNA, 340 bp, Homo sapiens
cagtaaaaatgttactggtgcctaagatgccatggcaatgtactaagaatcatagagaatgccagacatggaagacagtttcttaccataaagaaacttaaatatagaaggtttagaagatcatgtgaaaaattgaacagcaataacaaaataattaagcaatacttgaagacagccactgtagatgtcttataattaaatacatcataatttgccaagagaattactctgataataatgccaactagaggtcatatgggaaaaatcattaaatgaacatacaaaattcattaattagaaagttactacacgtcaaaacatcagttttgtatttattgct

SEQ ID NO: 139 - DNA, 191 bp, Homo sapiens
taaacaatcatcaaatgtatgttttgatatatagtaactttctaataaagaatttcttatgttcatttaatgattttttttccctatgacctgtaacagaaattattatctgggtaattcagttggcaaattataatgtatttaattataagccatctagagtggctctcttcaactattgtttaatgatg

SEQ ID NO: 140 - DNA, 36 bp, Homo sapiens
ttattttacaaaatatagcaatggaaaatccatata

SEQ ID NO: 141 - DNA, 124 bp, Homo sapiens
atatttcaaggaaaatttacagaggacaaccatcaggatctcttacagaacgtgactccttgtcaataataaaatgaatgtgagtctagggtaattcagctgggctaggcaaaaaggttaaagg

SEQ ID NO: 142 - DNA, 2061 bp, Homo sapiens
taacattattgaatgtcagtgcattatgctgttaggaattttttgttgttgttctttaaaaaagcaaacacatagaaataagaaatgcagtggtgtagggcttcagatcacagcccatttaggtctccttgtcttgacttcagtggcttctggagccactgtgtttaatcatatgattctgaggaagataactcaaagcttgggatgtatgtaccaatcagcctaaagttaattaacctacacttatacttaatgtatgttacatgttgacatattattctgatgtttaatggatctggattatttttatgattttataacaaattgaaactttcaatgatacaaaaaaataaaataaaataaagacttctggcccagggcattattcactgttttgtgttttttttttttttcttttttggttggggagggatggggcggggcaagcacacatctaaactagattttttgttttttaaaaatacagaaaaaccctattttttaaattggactttcttcaaaaatactgagcaaaggaagcaaacatttcacaaggctgtaaggacccttaaaatcttcttcaatggtgatttttattaatagacaatgctatgatgcaaaataaacaaaaggaactaaatgctgttatctggaattaaaagcacatacttaaagtaaaacatgaaatatatacactgcattatggaaataggttgactgtcaagcaggcaattaaaaactaaaatatagtgagccacagacacattcattttctaacaatggatgaataacaagtgggcttttttacctttcttttttctttcttacaaggaacacaagaatacaatgtatttcacagagtggagtacatattttcaaacaatgctgacacatctttattgttcagtctgtttctaggaaaattaaatctcctttttcagtttgtggacagttagctcggctgcacatgttaatagagaccctctacctgagttaatttaccatttagaactatctgagtgtgaaagtaatcctcgtggtaaacaacatgtactccatggtaaacacagcattatccccaggcccaatgacggagtcaactcaataaatagaagtcctggcagtaattcctaccttttacaattaaaaactaattattggttgaaaataaacagtgtggtaatttcattcattacatgcaacaaacaaagccctacaaagctcacgtatttgagaatttgttgtattttggttaatgaatgaagttaaaatacatatacatattttttaccatatttcttgacaatttcacaaggacaattacagcacaggcacaagaaaattgttgttaaaaaatgcagttgactaaaatgtgtaccacagaagatgatcatttgtccaataaagattctaagacatcaatgacacaattagtaaaggaacagaagttttctattgccaagacatttgctgcaaatataaccttcaatctcttttattaaatcacaactgaagacaccagtaatatggttagctagaatatgctctattaatggctaatatttattaatgcatagtaaatagctattacacataatttacatatatcctttaattctcacaacaatcatgagacctacctcatattcactgttcattttgaatacattagattcatttttgtgcatttaattcatgaaaaattcataatcaaattggttttgaagccgagtggagatgcttccatcaaatcaaaggctacagtagatactaaaagatactagaatatttatatacatttacacaataatccactactggagacttaacctgataaataatcataaaagtacttgcataagtcacaggagaaaaaaaatgaatcaacgcaaagtaaaaaaaataaaggtacagtgggaaagaaagtccctgtaaatttactacaaagaagttgtatttaatataaaaaagtattgtgcataattgttagagttgggttacaaactcaactctgatcaaagcagagagagaagtcaattataagattttgatatggtttgg

SEQ ID NO: 143 - DNA, 75 bp, Homo sapiens
gatttattgttcctaatataaaatgccaatggatagaataaagcccatttcccctctctgccctccctaataaat

SEQ ID NO: 144 - DNA, 1022 bp, Homo sapiens
tctccttacgtgcaaatcaaaagttctaaagtatagcttagtgaacaaatctactaagggactaaataatggtaaaaatacagacgtctcatatggtcttgtatgaataacaagcatatttagagtatatggtagaatgaattataaagtatttagggttgtagtttttaaaacttacacagaactcatggtctctgttatagacaccagagaaagagtgagagaggtggtaggtgtggtggagctctggtatcttactcctggttttacccggaacaactccttacttattacttctatattgggttttcttattatttgaagagaggttccactgaaaaggaaaaatgggtttattgtagcattaaccatcactgtgaaaatattacaacacaaaattgcaaaaatacagtaatggctaatcagtactccaaatttagtaataataattataaaagttgaattgtatacaattattacagttgaatcacaaattcaactctgacagtaaaagaaatgaaagagagaaatcaacttaaaagattcagtgccaagatgagccaatatattgctgcccttgtgggtgatgattatgtagagtaaaaagaattaaggaagatttttataagatactaacagaatacaaaatagtatgcatgggatgtttataactgtaaaaatgagtacatgtaaatgataaatggaaatacacaaagatgaaattttgttgtgatttcaaggttttttatctttaaacatccctttaaaaagatcaatgattttgactacataaagttttaggacaaaaggcaaatcactatatgatagaaaaatttgccacaaatgcaattgtaaaaggcttaatacccttattaaaattgaaaattattaaatgataggaaaaaagactctaaattttctaatttcaataatttggagtttgactagataaaaataacagcaacaaacattatgtaatattaccatattccaggaacctttcaaattaccttacataaatt

SEQ ID NO: 145 - DNA, 65 bp, Homo sapiens
cctgccaaagcaaattactctccggctctaccctattccaaaatattcataccacatcatgcagc

SEQ ID NO: 146 - DNA, 288 bp, Homo sapiens
atagcaagaactctctgctcatgctgtccctgtatcattgatcccaatattgctattgcacgatgtttgtttgacatttgcaaccattttgtagtcttgacctcttgttccctcatctcttggtcccctatggacattctagtccgtagggtttgattatctggatttcagaaagaatcccagggcgttgttaaattccatcaattataggttgttatagaaaaaaagagaacaaacacatctactataacatcctgatttgtcagaacatttaaatattgaagacat

SEQ ID NO: 147 - DNA, 538 bp, Homo sapiens
ttaattaattatttattaacttatttatttaggtgtgtgtgtgtgtagacaaccatacttacaaagctaatttctcatggtatataaatgtaaaagtggccagtgataatattagccagacaaataccctaacattagctctaatgtggataataaagttataaatgctttaactataattttaactatcattttcttactgagaaaaattacatgtacattatacagctactaacaggaggccagaaatccaggcttctaagaaagactgtgatatactactggacaatggaattcacatttgagaatacaagaagcatcaaaagcctttgtgtccagtcaacactttagagttttcctataaatagaaacaaatgtctttgtacccacattttttaaaactcagtattgttagtctattttactgttgagaccacaggaattgaatagccagaaaatgataggtcatagtgacagattcaaacttcactgctgtttctacctagcaaaaagccaaaacccaaccaatattccattg

SEQ ID NO: 148 - DNA, 400 bp, Homo sapiens
gctttctttaaaaagtgacttaaagattacagaacaaagggaatttttggacagaagtaaagagaatatgatgcatgtgatttagctaaaagtatggaaaaaagtcaattaccatattttcttaaaattcagatcaggaactaattttgcagttgtcaattttctaataacatgaaatcagatctttgaagtatcattataatatattaaaataattgatattaaacatggcctctacctcatttgggattaaaatcagtaaaatcatctcagctcctttagtgagagaattatcagactatgggaaagtaattttgttttgcttttgctttcaaatgagcaaatgctccttttaggaaaaaaatacagatgaatgaagaaaaaatataaaattaaagag

SEQ ID NO: 149 - DNA, 77 bp, Homo sapiens
ctcaccaccaacagctaacaaatataattacaataatgctttgcaataatgcaatgcagtaaaacactggacatgtg

SEQ ID NO: 150 - DNA, 90 bp, Homo sapiens
ctggcaacaatagagaatatatcatggacataaaggaagcaaatagtccacatccactggatatggactcacgtgtcaaatattatagac

SEQ ID NO: 151 - DNA, 944 bp, Homo sapiens
tggatgctatgcaagtgacaaatttcagataaacttataatctgaaaatacctaatattttaatatcttgatattgtctaccaaattaaccaattagcagaaaaaaatgcaaaatgaatttgttaatgtgagaaaaattatgtcctgaaaatgagttcagtagaaaacataatggtactattacacttagatttgatattcaattgtcttacttccatcaattcaatactttcccacacaaagtactttcaaataatgtcatgatcaatattgattgaaattcaagttgaagaaaataggatttttatgtactttattaagcactctctcatatatctcatgaaaaaatcatcagagatctagctacaaaattaacaagttcacttttgaagctgatgcatgggaactttatctgaatgagtggtggcctcattttcctccatttcttcaaattgccattttagtagagctacctatgtatcttttttaaaaaatacagataatgtcaattcaatcattcccaccaagtgattcaaatagaaaatactatatttaaatatcaaagctaaaagtgcaatttgaatagtccttgattctcacattgcaatacactatttcaatgtttaatagaatctagtaatagttgttttatgaggaatacatatacagttattctacaaagacgtaaagacaacaatttctaaaatttctacacaagaatagagtaagtctacactatagaagttagattacttatgatcatgcaatttctccaccccaaatacatatgtggtttagtgtttgtattattaggggacagaaaagtgcaggttcataattatatttttatagcatattatatcaagaaataatcttagaaattatctagttgtggcagaaaaatatcttttaatagttgtggcagaactaaaaattatccaatt

SEQ ID NO: 152 - DNA, 1103 bp, Homo sapiens
gatatatatatatttggagagatttactagattcactaggtttactagaataccattgtcactagaatggtttcctaattcacatatggtaggtgacagagccaaaatctgggagaaatttttgtctgattcattacttgaaaaaaagaaaaaaaaaaaagaattagctgaccagtaacaactactttaaattgctgtgtagggagatatagggtgcccaggtttgctcaggatgctctttgtgcccattttcccaaattaatatattccctttcacttgaaaaaatgtcttagtttgaatgatggtcactccggcaagataaaaacataaaacgtgtcttgtattaacccactcaggatggaggtttatcagtcacattctctgtaatatctttgctaatacattaattcaatcccttaattttataataaggaaattgatatttgatcttcataatgatttttttaagaaaagcagttagctcatatacaaagtgtgtcacgtatgtgtaaagtaaggcatagggagtaaagcaatttgccaaattgatagtgaaagagaattaaggctgctatttctaagtttccaattatctattgaactcagtatgtgacttaggtaccatggtacctttttgtttaggaaaatatgtatttcagtttgtattttctcagcacacaccaattagagaaaggatagaattgtccataagtatcctgaatggccataaaaaatttatttaacatagttcttgtgtctcctggaggcattttgtttctcatctacactgcagttgctgcttcaaaattttaacaaattaaagcccacttggcttcacgtcaaatccaatgtcccaaagtttttgttttgttttgtttgtttgttttttgccagcaagtatagtatagagagactcattactggaataaatagtgcctttatctaaaatcaatcagaattatattgactctggtcatgcaaacccgtacttggtacttgcatgcacacacacacaacccataccatgccccttcataaaagcctctggatcagagaggttggttgacaccggttgaacaacagagtttctactgtccatatc

SEQ ID NO: 153 - DNA, 153 bp, Homo sapiens
ccatcttaacttctggattatttctactagctgtttatgtccaggttcctctgtctcaatgtcattatcccacagccattcagtcaaaatcctcagcaatctgtttcctttctacatattttaattttggttaacatttatgagtaatgtata

SEQ ID NO: 154 - DNA, 506 bp, Homo sapiens
ggttactatcctctccccaggtactctttcctggtatcccatagttcctcaatagtgatcctttgctcttatctaattataacctgctttatgtatctttctactatcacatctttgctcatacccatctttacccccataatttttcctttgcctgtctacttgagtcttaatcttcaatactcagttctagttctacattgccctcaagctttcttcttatttcaatagtcccttatttgcctcaaatatgaaagcatgatattgccctcaagcttccttcttatttcagtagacccttatttgcctcaaatctgaaagcatgagatcaagagagaatctgaattagtagtgctgagtcacaaacgcaaagcagcaaaccattatcacccaggttaaacatcctgttgacaagttttatttggtctgcatagtcattttgcttttgtttccatttttaatttaaaattgtttccaaaacttaaaaacttttttagaaaaatgca

SEQ ID NO: 155 - DNA, 31 bp, Homo sapiens
caaaaaaacagaaaagtacagattttttttt

SEQ ID NO: 156 - DNA, 688 bp, Homo sapiens
tttaagctgtatctaagacaggtatgtcctaattaggttttataattactggcagatatttttaagtatcaaactttttgcttgtatttacacagcaattactgtagtacttgctaaatactgattgattccctgaatgactcttgtgctaactgaggcaaagtcagaaccaattcttccttctgacaaagaggaagagagacaaattagttttacccagcagttgatagccacaatgtgttgtctgctcctggaaagtgctctattaataccatcctgaggctctgtcctaccatagggcctgggtcagccatcctgcgctcccaggtaactggatgggacaaaggaataacagaagctctgtgaggttagatcactttaagtaaaggtccccaaattaaaacgtattcaaggcagacagatccaatttaatctgattttctctggtacaggcccaatattaagaagagaataattcatcagaataaaaaatgactcattaaagaagtgtttaagatatggaaagaagaaccaacaatagaaaaagacagttctaaagttctagctcttcaatttattcattgttttctttccctatacacaaaacaaagagaaatggacccacaataatctattaagcatataaaacaagttccaatttgcttgtccactagtcaacatggcggtc

SEQ ID NO: 157 - DNA, 469 bp, Homo sapiens
tatttagacaatattggacaagtgggaacttgtctgtaatttgaaagtatattataacttgcaaataaattgtgataattatagtaatcaatagcctaataaaagattgcataattgcatttttctgataatttaaatagggaaaaatgtatataaacctacttgtagtaaatcaacactttacctagaaataagtcagtgtaataaatcctaaggctgaaatatattgtttttatcttgccctacaaggatgaaactaacgggacaaacatttcaaaggttagaaaattttccatcaagcttctaagacacttagtgataccctttggtaccacattaataatacttataaataaatggttaagaagttagttaatccaagtttcttgtagcctgttagccttagttgtactggatagtaccactttcctgttcctttctcccacaataatatattataaacacacac

SEQ ID NO: 158 - DNA, 469 bp, Homo sapiens
gatagaaaagaacaacaaaaaaaagtatattaaagtgcttacgctaacaaaatctaaaataaaaactgctggtttcagaaagaaaaaccgaaatcacaaccaaaaatgtaagttgatctatgaggacccacacataggagtcagcaaatgtgattggagcttaatcaacaaagggaggacatgatacatggccttgagaccatgagggaaccggtataaagccttctgcataaaaactaggcacttgaagaactccaacttttgggaaaagtgagtaaaccatgtatactcattggctgacagacacagcaaattgttcttattctatttgatgtttcaggtataaaaagatattaccaccaaaaattaaaagattagaccttgttcacccattgataagaggccctgagagatgcagtataccaagttggcaaattaatctaaatatttatacaagaatattaacctc

SEQ ID NO: 159 - DNA, 97 bp, Homo sapiens
cctcaatatctttgaggttctggcagaagtcaatgcgcaattggccattaaagacatgttagccatacagggcttccaaaagaactccatgagaagg

SEQ ID NO: 160 - DNA, 37 bp, Homo sapiens
attgaactcaccgttcatgaagtgtttacacaaagaa

SEQ ID NO: 161 - DNA, 153 bp, Homo sapiens
catattggtcttctcttccatggaacaaatatgagaaactcttcagaaatataagaaaatttgtttatatagtcacattctttgaggataacacaataaaattagaaatgaataataagtatcttcctccaaagaatacatacaagaagtaaa

SEQ ID NO: 162 - DNA, 49 bp, Homo sapiens
gttctataagctcttagataccatattaaaagaactgataaataaatcg

SEQ ID NO: 163 - DNA, 105 bp, Homo sapiens
tcagaaatgaatataaaaaaatcaatatttactaattcttgatggagcatttatgcatcacaaaatacctttgtattatgagtgaccatatggataagctctttc

SEQ ID NO: 164 - DNA, 149 bp, Homo sapiens
aaattatgctgactttaatcaggtaggttttatgtgttattttaatgaggttcaatagaaatattatacccccattcagattttattcttttgatgagttccccagtgtctttcttatttgtttcattctgccctataataataagagt

SEQ ID NO: 165 - DNA, 413 bp, Homo sapiens
ctaattgtcacaggtaaaatgggtgaaggtttaagctataaagagttatttagatgctttgcaactagcattcatcttggagtttctgttaccatcactaacctatttctatagaaatccaaacacataaggaatgcaatgttctcagattgatgagctaaatctaaagagctaaatctaaagaatctaaagagaaggcacatgttggtacgattgctcctcaaataatcaatatgtttttgctaattttacagcatgaaagaatttatgtaccagggtaaagctaatcaaccccaaaataaaaatctccatgcctttcctctatttccatccttttaaaattttaatgatgtaaaaataagatactcacaacactgataacactttaaaaaactttagtgtttcacatggta

SEQ ID NO: 166 - DNA, 108 bp, Homo sapiens
attttcatttatgcctgacaattatcccagtgcatggcacagtacatgactttcgatgaatgttcgaaacatgtttgttcaacatgttggatgaataaactaatatat

SEQ ID NO: 167 - DNA, 565 bp, Homo sapiens
ccatatatgcaaaagggttgtaagcaaatgagcactaagtaaaaaattaccatcttgctatttattcttaaaagcactgatgaaataagatgtttactaaagtactattggttgtgaaaacaatacaaaatttctgacgtgcatatgcaacctaaaatatgaaatccagaatatagtttgttcaatttttatggaaagtgacatttaacaaagagtaaagcaagaatattttattccctgatttttgtgtgcttaatcagtctttacttagttctcatcattactgtaataggtacacaaaagttcaacttttaagccaaagattgcgtttatgaattctgtaacttagcactgtattttgctttaaagcctgaatattaaaacttcaagtgaaatttcttgtcaaatagttataatttctttgaaatgccgatttactaatgtaacttgggcagtcagttttgcaaagtgggctatatctgcattgcaatgagtttatactaattgtttagtatatagaacacaacttagtttccttatttgcaatctgggtagacagattgaa

SEQ ID NO: 168 - DNA, 74 bp, Homo sapiens
ttgagttttagtccaaggtaacagaatatttagaattacgaggagataagtattcgtaaaggaattcccttcat

SEQ ID NO: 169 - DNA, 443 bp, Homo sapiens
gaaattctcttaagcactataacttcatgtcatgactcatacagattaaaaatctcaatatagatatctctaatatttactcccttcaacaattattgtaatctctctatatattctaaagattttatagaacaaatctatggcttcttcaaatgtatattatcagtgccactttcaaacagactttctgaaattttctaacttaggactacaatgtcccttcttcctctaaacagccgctcaatgtctcattttctatgcttagaggtccaagactatggtttactttcattttaaagaaaacttactgaaataagatttcgatatcagtgttatttactctcaccattagaattgtagaaatattttttattaaacaacaattgctgtttattttgcatgctgccaaatgatactcctggatttattcactcatacatgca

SEQ ID NO: 170 - DNA, 103 bp, Homo sapiens
actggcttctttagagagaatagattgtagggagataaaagcaaatggatgaagaccagttagtaagctgtggtaatagttcaattgagataatagtatattt

SEQ ID NO: 171 - DNA, 201 bp, Homo sapiens
atcatcagtttaattgcatgctactaaaatgggtgactggttttaagcactctgatgtggagagaactcagtgagttatgcaggacagagctgttgtcttgccaggatgatgcggcatagaagagatgatttcaaagacagtcctctcccttagtgtatctttcacgtaactgtattcccataacaatattacttcatctc

SEQ ID NO: 172 - DNA, 846 bp, Homo sapiens
cctaaacagaagtgttcttctaaatgaaatgaccatgaccatacagcatactgaatgctttccaagttccaaattaaggaaaaactttattcttctgttatgtttctaattttagttcagccaaaggagcgagacatgtgttcaacatgttttctctattttcctttggttctctaagatgctgacaatttctaaggaaactagttgaagtaatttggcctcaaaattagagtgaaagtcactgaaatctgactagtaaaaccttatcctaagaccttaccctggtattattctggcttttaattttagtgctagaaatttaaattaagcatcccagtcaaaagttctgatcccaggtggaaaaatattgttctcgccaaaaatcattaaaagctaaagaactaagaacccaaaaactgaagaataaaaatactttgaacaactaggattttcagttaattttggagaagcactcatgggcttaaagcatctccaatcattttatcttgatatcctccagggattgagtgctcactacaaagcagtgtatctgcaaacttttacttagatacactgttaagtatacagattttcatttggttattttttttgaggtaaaagataatacttctcaaaatttaggaagacctttgtgttgttccttctttttgggcataaaatatatttggcctcataacagatttggtctttaattaaatcttgctgtcccttaaagagagtggttcaggtatgctcttccccatactcctccctctgcatgactatagtaatacatgcatttttcattacatgtagaacacagaaaagttaagataagtacatact

SEQ ID NO: 173 - DNA, 241 bp, Homo sapiens
ggagggaagggtggaaaggagggaagggggaagtggggaagggggaaagaagggagagggagggagggatagcggggaggggagagtgggctgcggggaaggccagcttcgccattactccacaaacttctgctgagttttctctgtgatgagatcaggacagctcttacctggaggactctgaacctgactcccacctcatgtttatttcatgttacatgcatgaaataaaatgcatgta

SEQ ID NO: 174 - DNA, 56 bp, Homo sapiens
tttgatagcatgttaatattagtaattacctattcataacagcattactattgctc

SEQ ID NO: 175 - DNA, 573 bp, Homo sapiens
tgaaattttaattttgatatcaaagctctggaaatttttaatatgattgtggatgtagatatgggaggaatttttggttttattttcctcattcactgtctgcagaccacactttctctgctcaactcaatgtgtaagagtaaagttcaaactcctgttaacatctgcttttcatttataaatttgcttttctttagttaaatgttcttttaggctagagtttctatattgattgtgatcattagcatttgaaatgtatcagttatgctaaattcctcagtgttgagtaacatttagggaaatatagaaacctgtaagttgcttgatgactttaattatgacacaagtctttcttatacaaacaaagaattcatctttgcaaattataaataaatataagcaaataacataaagaatcctaatttttccctcttcagaaattaacagtagtttaactaaaagcctgagatttcttgtttgttaaggtgtcgtttatcgttaatatctgtgttctgtgggcaatagcttttattcttttaggtacagatatatcaaaattccttcccactcccc

SEQ ID NO: 176 - DNA, 192 bp, Homo sapiens
ttataaaataaaacagaaattcccctcatatctgttaacatgttcttacatttaagattcctttaaaaagaaaaggtatttggcaggacaatattaaagataaagattgccgctttaattttgattaatcatttgggattcagattctataatccataattcgagtactgatgagagactgcaaaaaaaaat

SEQ ID NO: 177 - DNA, 316 bp, Homo sapiens
ctggttactcagaaacactgcccagttgttctttttgaggtaactttttgatcccaaatttcctatacttcttgaaaaataaaagtctatttaagaataattacatgccaggtcattttgcttattgatgatatggttcttgacattagcacaaattataataatcaaaaaaaaatgatccctaaatttctgagtcaatctcaaaagatttttaaattttaggtatctgaaagcccttatactaccattacattcattggggggttcatcatagaggaaagtaatagaaaaatttagtgacttatacaaaataggt

SEQ ID NO: 178 - DNA, 250 bp, Homo sapiens
gctgcatatatcccatttaagtatgtggtgggggaggtcttacttattctggaacatggttatggctagcacaaatgtattaatgcccttgcaatgatagaagatgaggttttaaggataggggataaggctttggctttgtttatcctttgcaagtagcactttcagggtctaagggatccaccgattaggaaaagtctgcaacaaggtatttttagcttctttgaatctagattttgtttaaagtctc

SEQ ID NO: 179 - DNA, 88 bp, Homo sapiens
gatcacaccttgggaaaattgaacacttcaatttgtaccaacctcttggtgtcaaaatgcaaaaccaagaaacaaatatagaaaatat

SEQ ID NO: 180 - DNA, 29 bp, Homo sapiens
cgatttgactaattaaatgaagtgatttt

SEQ ID NO: 181 - DNA, 150 bp, Homo sapiens
ttttaacaagtgcttcttactagaagtattcaaaaaaaaaatgctaattccctgctcctctttcccgctatttcttgctttctaattaaaaactgaaattaaaatttaagattgtttcgataccttctcctataggcttgtttcatagtt

SEQ ID NO: 182 - DNA, 35 bp, Homo sapiens
acctctctgttatgatgctttcatctgcaattttc

SEQ ID NO: 183 - DNA, 493 bp, Homo sapiens
gcaagaagattacttcatcaaaagatgctcatgggataaagacttttacataaaacagagcaaagctctttactgaaagtagaaatatggaatagaaagcatggacatatacatcaaatgttgaatttataaaatttttcaaaattactataccattaattggaaaaaattcatttcttttccagataatatcttataagaaacaattcagccttaagcaatttttccctcttctttatggaaggtaagctgagtttctaatggatttgctggcagccctgtaagccactcagcaaatgctagaatagacaatttgtgttctggcttgctataatcacatcaaaatttctgttgtgtttgctcagtaaggggatgtttgctttccagttgaactcaaaacaaaaggcttgcacacaatcttatatatgcttagtctcccatttcttttgtgatgtgtatctgtgtacacattccatttattcatttttttcaa

SEQ ID NO: 184 - DNA, 919 bp, Homo sapiens
agatacaaacttaaagtgttgacctatttttgataagatgattaaaagatgcctttctaagtactgattctaagtacatgaggaccatattttttaaaaacttttttacatcaatggatattgctctgccagccctgatgagaatggcttaatagcggcattataggaatggggcagcttcatcacatagccactaaatgcctctaggcaggctggcatgttaaatatgggacaatcagaattgagaattcaacaataggcaacatatccagctttcattttctctctccttccttgccccatttaccttactcaccatattttactcccaccccaaatattatctttactatgttctgctccttcatccaccgtcagtcctaggacccacctcaccaccgtgtatatatgaatggcaagtccttcttcctatctccaagtctttgctcgtgcttccccttctgaaggctcttctccatttagcccagttcaattttccttcaaaggcaaatttactgtgcagttcacccaacaaaacatggaaggcaaaacttaaaatgtattcattctttcattcctttattcaacacactccttttaacactaggcaatgtgctagattctgagaaaatatgaagtgaaaaaatatataccatgaacatcatttgtaagagatattatgagaaactctgaaataggtgcttaatgaattcaaagtatgaagaacaaattttgcatatcttaacttgtcacaggaaagaattaggattatttacaatcacttgtgaaaccttacacacattacaagaaaatgataacattttaataaatcataataaaaatacacacatagaaactgccatatttacttttccatgtacgggaatatatttatctcctttttagtcactgaattaat

SEQ ID NO: 185 - DNA, 1573 bp, Homo sapiens
tcatgattaggctgcttatgaagtcctcctaactggaggttaaactttacgcagcaataactgagggatcagtcactcaacacttttgttcatcaacttttcaatctataaaagaaagactgcagatcctattctctgccaaacagttactattaacacaagattcccccattcaaattaaccaaaataaaaatgttagttggctggaagtttcactttaagaatagtttttttgttggtggtggtgtgttaaggctgattctacaaaatgactgtcatcgattggcaactttctgctcaccaccttattgattagctaaagcaaattttagtttttccacaaggacagggccttgtctttcttctataataataatacatactgtagtgcctaccatttattaagtaaataattgctgaatgaaagactcattcaatcggtccattaactataaacagtgctttttacaatgctaaaacaattctgaactacttattttctttataatctattttatatgtcatttctatttcagttcaaaattagtatgggagagtctaagctaataaggttgcaatgtacatgttgtacatcaaacaagcagagacaacgtgcaatacaaaaattacctggctgcctaatatagagctcccggctaatatatgggacacggcaagcaactgatccatgcctgttgatttgatttttgatttgacaggtgagttggagagcaaaggcacttaagcattccaatctgatttttctatttacatcatttccaccagggagaacatgtctcctctggtctcactatgtatctaaatttgtgggcttatatatctgtatatggttgaaatttttacctggtttaatgagcaaagctatgtgcaactatacctaaaaactattacaaacattaccttaaaattaaaaacaaaaacagtatatcatcaagatgctcaacctggttcctaaataagctccttgatcatggttattttgtttaagcctgataattaactctctctagccacccagagaaaataagtagaagtagcaaattctaccttctgtgctttccattgggcaagaaactattttgtctgccactttatctgaagttaaaagcaatggttcaaaaaaccctgacccctaattggagacgaatatgactgacctagtttatgcaaaagcggctttaccgtgtggctttagtgcagactggaagaaacacagtattaaacagtaatcatgagcaatatttgatgttaaggaaaaaggcgggagttttttatttgctaacggaaaaaatacatgcaaaaaggccattttctgacataaaatatattcttcaggcaaaaatatacatgttgctttctaattgttgctggtattcttaagcgttgaaagaagcaattttaaatagtgcagttttatgtgaattttttaaatgacaggaatttgataaaaggaaattaaaaggattgaaaggtacatgttaaagtttcgagaaacataagagctggtcaataggaccacagtttacctatacagctgtatataaaatctcac

SEQ ID NO: 186 - DNA, 750 bp, Homo sapiens
ctcaccaacacaaatgtttgtattgggttcatataccagacttgcgcagaagataatgacaaagaaagaagtcatataaagacagacgtctctctcgaatcttgttctatttggaaaaacatgttcatattgggctctgctccctatccaatcccctgacatccagaaaagggaaatacggagaattaaggcaaggaaagaccaaattcaatgacattgttagagtaaacatcaccatcactgtatttagggtttctctgtcttttagacttatacctttctggctaacatgaggaggataagaaggaaagtgtttgatcctatttagaaggatggccatagaaaatcttggatcttctggcttctgtgagttcctttcagggcttaagaagcagcaagtttctttccttcacatggtttttcctagacctggttttggggcatgaaataaatcttagcatcctcaacccaagaaactcacaaggtttgggacatgagcatattggcagtaaagagaaaaggctttgtgttggtctatcctttggctctgcctattgctctaagtagctttcagagatgactgtgagaggacaggatgtgtgcacttaggctctgggttcttggccatatattatctccatcccagcagagagccagccattctctctgtacctttcccacaatactgctaaatactgctaacagtttcaataatctcctttcccctgagactacactctaaactttatg

SEQ ID NO: 187 - DNA, 1166 bp, Homo sapiens
gttgtggctttgacagttaaccatggttaagccttggttacactttgataactttatacttttaaatgcttaattttggggcagtcactcatctgtaatcttcatcaaagtgaagtgttttgttttaaaggattgaggtgtgttgatttgaaaaaaaaaaatgcaagtcaaggaaaactgcaaagtataatgtgtatgaaataagctaccagtggttttgattgggtacagacaagcctgtacttgcatgttccaagagaatatattattggacctgtttagccttgataatgacctttcttataaacttcggtagcatcatactgcttcattattttttgcaaaaggttaagtagcatctcacaagccaagatcattgtgattactacatggtatgtttctgccagaagtttttactaattgcaagtcactcaccacctgttgcagatttcttttttaaaattaaagcactgctttttaaccttaaaaatcgactgtaatcaatattaataacgtgttttttctataccagtccagtttgtattttttaatcttaccttatagcctgtaatttaaagtgcaccttataaagcaggttccaaacctgtgttaaacaacatgtgtatgtaacaactacagcatcattatttttcctttcattttagtttgttttgccttccagttagaacctgtaaatatatttatttcacagtttatatagcgcctaccagaatgacatctatctgggtgctctacagttttaagacaatttcaatactaaaacacacaaatgagaccaagccaacaagtgacagaacaaagccacaccttaatacactttcttatttttctaagacaagctagaaagcaacccagaagagcctgaagggaatggtaatatctgtaatggaattttattttatgttagcaggatctttaactctgggatcagaaacctttcagaaatgccatgccttttattttgaagggggagttagctggtgttaagaggggccttgctcctaaaccagctttcaagtagtagggataaaagtctgataacagccatcagctcacatgctggtggtcactaatgattttctaacagatttttttttactcttatacttagtagtagagaaaaattatgattcactgtagactgc

SEQ ID NO: 188 - DNA, 140 bp, Homo sapiens
aatgttattttttaaagtactacttgacagtgttgaaataagctaagagacaaaggttattttcacgttcatgttttatataatagaagccactaataatcctgatagagaggagaaagtataatgcctatcctctaggc

SEQ ID NO: 189 - DNA, 309 bp, Homo sapiens
gcacttggaacatttggctattactttcaaatgtttagaattgagagttaacaagcatttattttagtaactaaattttttaaactattccattataaactgttcagtgacattttggattcttaagtgtcacagtaaatttgaagattggtagtcagtctcatggaaatttactaaatattgatgcatagatgcatgtgctaaggctaagagcctctaagtatagtcttgagtacagttgcattgtttaatagagttaagctatttggaaaacattgtttcagtaattactgaacatataagttataa

SEQ ID NO: 190 - DNA, 768 bp, Homo sapiens
ggcatagaaaatatatatacagttaaaaaaatttaaagtacaaagtcatttagcaaaaactctcccttcctcttttgccttctgcaactcagttctccactctagagggaaccacaaaacacattttgtttcttttcagttattctatttatattcaaaaagcttcattttagaacgtgatttaaaggatatcagttaccaccgtattttcagtttatcaatataaaataaattaaggcaaacaaatttgtctttagatccaagcacacctttttaaggagcatgaaaacttttaaaaacttatcaggaacccatgaatagcttatatataatccgtaagccgtgtgttttataatgcacctgcttttccacagcagtgagtgcatagaggtaaaatcataagtcagttggtcttgtgtagttctacatgaacccaaaaaggacatggccggttgacttatgatttgggaggaaggcactgggggcacacagcaggtgagtaagtgaaattgaaagactacttgaggatatcatttgatttaaacttacctttgttttgttattgttatacctgctgatctttcatgctgtctgtgttagttttaatgcttttatctatataatgtaattgaaaatcaagtagattgtgccttcagacaccagttaatatttcattagtacagttagtctcaaaaatatagggcctagtatctgtgagtccattaactggcttctgtatgtattggctacagcagttactagctttat

SEQ ID NO: 191 - DNA, 390 bp, Homo sapiens
tctaccaggctgattcacctcctaatgtacacgaatatgagcacagattaaaggaagccctgatcatttctactttttgatctgtacagtatagcatttttatgcactaaaatttaattcattgcttctgatgattattgaaatgagtaaggatttaatatacactcttggtactttacaatcagtcactgctccctatggaatttcatagctcacttttataacagacattggtaaaataagaatctattgttaaagtactcatctaaaatattttaatactcattggagtgatttttgctagcaaagcttaaaaattaacataatgctttgtttcatcctgatccttaaagtaaatagacttaatccaagaatttcctgacatgtatt

SEQ ID NO: 192 - DNA, 1464 bp, Homo sapiens
agatactagctgctcattaaatgttctcttctttaccccttcttcctctacctcagtgacatcttaagacctacattgtaaaagtctattagttagagaagtggtggttattttggttagtttttctctttagattcctgagggttaaccccaaagtcctttttgtttttatacttgttaaaaatatccctaaaggtttatttctgactttcatgtttttctaggctgccagaggatcctttaggtccaccagagtactgttgaacctcatttgaacacttgatgttgtcagagttagatatgggggcagttgtgaattgatttcaggacatccaggattattgtttcttaataaagccatgctattagcttaagattttattatgattggcctgttcaccttggagacagagtgaggtgaaaaaaattctggttggtgagattgcatgtcactggataagagcatgagctagacagacccagtaaagaccaaaatccacatagttaatttggagacatgcataacataattatttgaatcaatcaaaactgaattaggaaaaggggaattccagattaatgtgggtaaagaaacagctgtgttattgtggctttttaggcttttcatttgaaatacccatgagccccctagatatcataaagttagatttaataaattatgaatgatttataaacttagcttatgataagatcaaaccttatctctgactgagcaaggctactgaaactgcttaatttgtgctcctccatatcatgctttgaagaatgtgtaacccgttcctctaaaccttagttttaaacttgtagctaagaagaatactttaatttcatcttaatttacttgaaataaaatgcctttattagaggatggtacaggtattatgtaagaatatatcaacagtttcaaacatttttattaggtgaaaaatattaatttgtcctttttaaaatcatttatctatataggcattaattcatggactaaacagacattattactccattactattaactatcggaaaaatgaactggaacagaaggtaagtttaaatttttatcttataggaggaaaaaaatctttttcaaaccatttaaactattacctggtatgtgatttaaattcgaatttttgacctctttcagtgtttccaaatattattccattattgatgaattgcagcacaaaataagggaatattttattggactatttaaagacacatttcaccttattggtaggtgctgaagtgggagaggaagtaggaaataaatcaaacgttccactttggttttatgataagtcataaaaatatttcttttagttctgtgatttttctgattaacttatcttcttcaataaaaaggccttttgtaattaaattagtaatatattgctctgtaaatttgagaggaataacttaaattgcagttgtgtagtgctt

SEQ ID NO: 193 - DNA, 491 bp, Homo sapiens
tagtgcttttagaaaacataccatgtttactctaaagaaaactaagctgagtcaaagggaaacagttttagggttttcagataatttgtactagattctgatcccattttataccagttttcaagtttgattagtttttaacattacctgacgttttgatgaattagcattctcatttgtttctattttaggattatttctagtacagtttttctctcaactaatgccaagtatttaaatctgcctgttgttttttgatattacaatctgaaccagtttcccccctttactattacaattagtcatccacctaattagtttcttgtatttctctctgggaaagttaaaagcattttttaaaagaacactgagtttactgttgattgatagccagtaagttttggttagtgagaccgctgtcaagtcagaaagtgataagtaatcagtagcaaataagatcattctatctagcccaaactgtttctcaccaa

SEQ ID NO: 194 - DNA, 1418 bp, Homo sapiens
aattttgtttttttaagtttgataaactagagttttaaaaggtcaaatccactcataaactcatctgaagggcccagtgcttgagcatgtgatgagtgaggggagtgggggaccacttcccccttggcgcaaggggatcttataatgctctcttctaattgcctgcctgtgtaccacagtttacttctgctgtgatagatttagttgattaagtgtatttttaacacttatttttaagtttacatggaatgagtacagtctgtgaaaaatggcaccattcagggacaaacaaaattcattcagaatataaatattttatcagactgatatctgacacccatctatttggaaatgtctagctaattacatcaatttttctttctttttttttggggagtatctcataaacttagccattttccttggcataaaaagcaaatatataagcacttacataaattacttaatgttatgtttatgttcttaatagctcagtttagctgttaacctgccttcttggtaacaaaagctctgcctttactcttatccagacaacttgtttacttaacccccagccttactcgagggtcgcaagggaatccttgtccaggtatgataggaatatcctgttgctccttgggaactgtctttgtttgcttttgaagtggtagggaaatctgagtctcaacacttaattataggtagctgtatagcataggtagttgtagcagcacccacatttcccaaacatgtattttctagaacagtatcagtggagaagctaggaaggaatcagagaaactgaaatcatctgtggagggttttcctaattttttttggcatactgtccttacccctggagccatgggagaaaatgggagaattagtgtccttggagccaaaggaagggaatggaggagttttgtatcttcaaaagccttataggtgattttgacaggcagcttattttccaatgtaagataaaatttgtaccacaaatagctgtaaacttctaagcaagtaggataatttttctaaactaaacccccatatacctccaagtacatcttcagattcttatggctcagggatctcatttaaagtataatggttctattgacgaaacaacagtcattttatagccatcattttttttcttttacttttcacaattttgtgaatcatccaaagggaaaaaacttcttatttaatgatggtcctcaattgaagaaaatttgtagggtaggactttaagaaaaaccgtcttaaaatataaacttgaaaacttaggaacatctaagaataagtactcagaattgtaagtccaatttgagaaacattgaactaaggtgtttagtttcatgatcactgatatagaatccaaccccaatttgctggtgtgattgcacactagataa

SEQ ID NO: 195 - DNA, 76 bp, Homo sapiens
tagataaatcttttatttgagaataaaagattttcatggcttttcatcctgacaataaggaagttttaagttttta

SEQ ID NO: 196 - DNA, 70 bp, Homo sapiens
tttatctcgttatcttggcatttgaaagctaggctatatgaaaaattagagatacttataaatttcatta

SEQ ID NO: 197 - DNA, 393 bp, Homo sapiens
taagttatattaatacaaatataggagcattctaattggagttcatttgaattaataaagttaaatccattaagtcgaaatgtttttttttttttgaagttttttttctctagacaatgaagggggtatcctcaaggcagaaaaagaattactttttcttttattttttagatgttgctaaatttgcataagaagagttggatggaaggtttgacacttcaggactacagtgaacattgtaaacacaatgaatcagtggtaaaagagatgttggaattagccaagaattacaataaggtaaaagttacttctgccatttcttctttataatctttggaatatgtatgattagatgccaagcattgtgtaagtaattaaaaatagagaatcctg

SEQ ID NO: 198 - DNA, 142 bp, Homo sapiens
ttgtagaccatgtaatacagttgcacatttgaaatctcttcattatttagggtatttttttcttgaaagggacaaggagtaaggggatatagataacaacagcacttactacttgctgtgtctaatttattttatgaacgtt

SEQ ID NO: 199 - DNA, 314 bp, Homo sapiens
taataattatttattgaaaatctaatgtgccaggcatatcatacatgtatacatatagattgcaactcattaatgggttgaaaacctacaattttaaaatacacatttatacattatgcagtgttatattaacaaatatttattgaacatctcttatacaagttataatagaaaatggatccttgctttatttataggaaaacaggaacagttagacaagcttctaaataaccagggcattagttaaaaatcagtctgtaccataacaccttcatattcagattgtccacacaccagctacattagcatcacct

SEQ ID NO: 200 - DNA, 129 bp, Homo sapiens
atgtctactcttgtagttagacattagagaaacactaccatagagaagaccatgggaagccctgtaggagctcataggctctgactttcaagctggccaacacccaggttgctgccttacagataaaca

SEQ ID NO: 201 - DNA, 113 bp, Homo sapiens
aaggaagcaattagaatgtgggactaggaattaatggtaaaggctagagctcaagatttcaggatcatagttaagattgttgttggttattacaccaaaacgtagtatttccc

SEQ ID NO: 202 - DNA, 1452 bp, Homo sapiens
ccaagagacagtgtataaaatttaccaagtgtagcaataagacttttgagagaactaagctttaaaataaagttgatgggcccatacaaatgaaatcccagcagaattagggttggctttgaaaagtatgccctgattatagtgtttcaactggaaatccccattagtgctagattgtagggaaaatatttcttatctttctagtatacgttttcatgctgtggagattagataaagagaaataaatcgctcaccgtattttaaatagttaaccttttataagtaaaaaagttatgacttaagtaattattcagcagactgtaggaatggttttcatttctctttaacattacacgtttaagtaaatttgtattggtactactgccaggaaataacctatttatggttactgctgcccatctacagaagtttttcctattttacagttttaaaaaatctctgtagtactcaaaaacttgtaaggtttggttataaaatgaaaacaatgtgtaagctgtgatatgaaagagtccaaatttgggaatgtaattccctctgtgattgaaagaaatacggtgggtttttttagtaacacttaaaatataaaaagaaaggcccatgctaccaattcttcatagtattctttttaattggttggtgttttaagctaaggtaattgctgttggatgccagttaggtcctaaagtaaaagaaggttagagaataattaaattcttacgtcccaagttttcagtttcaagtctgaattccacacaaattctgcttgattattattagacatttgatttttttctaattactgaaccacaacacccacagttctgttactccaagtctcctaatttattcatgcggagatgcatctgctatttttttttaattttgataatgtttgattacatatttgtaaatgaatgtgcaggtgaaaaaatgaattgtgaagaacattttaagaatagcatagaaacaaaaatttgccttttttttcccaagcatgtagtgctataaatttggagatctgacggtttactgttcaggtagaaatactgacctacttagtaacctgaaagaaagtttcagtatttcttttatatgcttacatatgaaatatgtaaatatacaattacaattggtttaatacagtagctatattaaatggagaaatctcatttggtagtacaatatgataaaaacaacagatataaatattggggaaaacaggtaagatgattattatttggatatgatagaatgtgtttgcaatcaaacataaaaatctaagagaataaacttagaaaactcttagaactgttttaatcaagaattatgtaggtggtaaacagttatataaactgaaaacagttgaaaaatataataggcaaatcagttcacagtaccatctaaaattataaaaatattcaggaattaacc

SEQ ID NO: 203 - DNA, 79 bp, Homo sapiens
ggttactataattctagtaagaatattaacgtgagctttgaaaaatttgataacatgacattaaagtttatcttcataa

SEQ ID NO: 204 - DNA, 75 bp, Homo sapiens
aatggaagaaaatatttttacctataacacagagtgagctagtatccaaaaatgcataatattcagagaattcct

SEQ ID NO: 205 - DNA, 75 bp, Homo sapiens
gttgagcaaaagagaaaactcactgaagacaaatggtgtataaacatggaaaagttctagcctttttaagtcgtc

SEQ ID NO: 206 - DNA, 396 bp, Homo sapiens
ggaaaatataccactagtgggaaagtaattgatacatttttggaggccgtctttcagttttaagtgcatataactctttaaaccacatgttctctttaaaggatttattatgaaaaataaaatttcacaaaaacatacagaaatatctacaacctgctgttagatgtacaaaattaaattgtataacaatgttaaaataattcctatcacgttatcttctctccctttttcaaaagtatctctatcttgcatatatgtcaacatattgtgttggtaacagtgtgtgtgaggcaggagactcctatactttatgtaacgcctgaattattttcagtttttgcattaaacaagtaatacttagatctaaggttgtgttagctcaaaataacaatggct

SEQ ID NO: 207 - DNA, 270 bp, Homo sapiens
gaaattttttccaacaaccttaactacagtttctcttacatacatatatacacacacaagcatgtgtgcacatacatatatgatctttattattcatctctatttcatgtaattacattctgaaattgaattctctgtgaaatttttatgaagcaactatgttgtttagggccacttaataaatcatgcatttgacattattattattattattcaggttgtatcagtgaaaagtaatgatttccccaattgccatgaatgtttctttga

SEQ ID NO: 208 - DNA, 33 bp, Homo sapiens
atgatagctacaaccacttctgatgttattaat

SEQ ID NO: 209 - DNA, 305 bp, Homo sapiens
tgcaaattggttcatgtcactaccgtgcttttaaaaagcctttgatgactgacttctcattgccttagaatgaggtccaaaccccatttggctcctgcttgcctctgttgctttatttcttatcactgttgtgttgttgaaatactgagtaatttgcagttcttctaacttataatgctttttcttgcttcctggcctgaagcactccttactactatattcccatccccactccttttcattcaattctcagcctaaccctttctcacttttgagaccctcaccataccaccaaatgagtgcta

SEQ ID NO: 210 - DNA, 1667 bp, Homo sapiens
attatgctatacttgtatttttctaccaaaaatgtaactttattaagtggccaatcataagcactgttattaactaatattaacataatataaactaaaatttaaggaaatgcaatgtcctctaaggggcacctttcttcctaatcttcaactgttctctatcatggcaccctttgcccctctcccttccttgaggctaactggataaaatataacctcctacgtcattgatcatttccttccacctgcctccagtattctcggagtcataaccttttcatgacagagtatggcgctgatgacaatttgctgtttccagcttgttaaaagagatgagtgatttattttcttagtgcactgagtcttgcatctctttcagttattttccttgtcctcttgccttcacatcatacctttgaacttctgaagtctctttttacttccatggccatacattcccgtggttcccctgactttttggcaactacacactctgctgcctttgctatgagcatttccaagattcagcccttgcctttctgctcttctgtttttatacctttctttaaaagtctgttttcatagtttagcaatgccaacaactttgaaatctcttcatttcctctcatttgaaatgtattatcatctccactgtctgagacctttccagttacatgttcattacttcagatgctgctgttcaagagtaagcaatattgtctaccctactttctactttttcatgacagttccctctaccaatttggttataactgacactcatttttctaggcatcgtgtaggtttgaaactttggactcatctctcttgctcttcttccacatccagccattctcccatggtttttccctttccctgttactactaagtatcacatgatgtgttcctccctaatgcattctttatactctcatcctgactctccctctgtttccccaggtgatccacaagaaaaagttaggtacatttacttaacccctatgtccccatcgtgctttgtgcacactccttttttgtatgttttacactgcattatgatttgagaaaagcccaaatgtgagctccttgagagcaagaagagtttgaaaaattccttttatgctagaaattttgctggaattaacatatgaagtgtagattaacttctttattgagatgttttaaggattcagtaaattaatatttgtaaaatcatgcctatattgatgtttaattagtgatggtagtagaaaaactagttttaatgtcttcatataacacataatattgtttatatagtcaatactttaaaaatcatgaaagaagtaaaatacatatttttgaaatccactagcagttatgcattgattgcttaatagtgaaaaattagtatatgccattttagcagtttgtgctgtcttatgtaaaaattgccataatggtgatattaaaaagatatttaaatgggatcatggcatgttatagtgcgaacaaagttaacatgttaatgtgggaaaaagaaaccaaagaaatagtgaaagaagtatgatgtggaataagagagatacagggtggcaaaagcaaaggctaagggaatagaagagaagacagatgttggagtagctctaagtatgttcagaaagttaaaaacaacaacaacaaaaaca

SEQ ID NO: 211 - DNA, 71 bp, Homo sapiens
ttttttttatcactcatccacctcccaatgactcccttctgagtctccaaagtccattatatcactctgta

SEQ ID NO: 212 - DNA, 158 bp, Homo sapiens
taaatatacatgtgcatgtgagacaagcattttaagattacttttaagtttgtaaaattgatgctcaaatgttaaattcattctcctttccctgactggaatgagaatttaatggcaaaatcattaatggttttaatataacaacaaaaacaagaaga

SEQ ID NO: 213 - DNA, 158 bp, Homo sapiens
aaaatcctgcaaggtggtcatgtaccacattggtatatgtaaatcaatagtttttcaattaacaaatattaataggaacatatttgcaaaagacctaatttataatgccaatttaaaaaatcataaaatatccagaaataaatataagaagtaagtag

SEQ ID NO: 214 - DNA, 235 bp, Homo sapiens
tctttttcttggagaggaggacaggaggaaaaattgtccagttgatttctaagtttattttaataatacgtatataagaacatgtaggaatattcttaggataattataaacgaggagtgataaacccccaaaactacaaaaatagaggatactagaaatgagaatagacagataaggaaaatgagaaagtgacctaggtatctaatagattcaatattgtttaaaagtcattag

SEQ ID NO: 215 - DNA, 135 bp, Homo sapiens
gggacatctgaatagccatttagaaaaaaataaactaaatcaactacctcatttaccctgagacataccattatgttgactcttacgaaaatgcttagatttgatattttgacccaatgtatgattcaacctaac

SEQ ID NO: 216 - DNA, 170 bp, Homo sapiens
gcataaagatgtttcccaataagacacaaactccaaaagtcaggaaaagtttgattaatttgactatgtaatgacataaaatacaaatgtaaaagaaaaaaattacctctctaaattaaaaaataatgagctaggaatttacttgcagcacatatgacatactgatcatt

SEQ ID NO: 217 - DNA, 183 bp, Homo sapiens
ctttgatttacaagggatttgtacaaatcaataataaaaaatgcactattcagcagtaaaataaacatagtacatggagaagcaattttaggcgagaataaaagagacccaacaaaggaccaataataatataatcatatgctcaatttaattcacaaaaaatgccagtcagaacaacaatat

SEQ ID NO: 218 - DNA, 192 bp, Homo sapiens
tttttctataaattttaactagtgttcctactatactatgtatttattcacttagcaaatgcttatcatcatttgtttaatgcaagactgtggtataatgccgggggatatataaaaatgaaaaagtttgactatagatgaagatgggagaaagaatgaataaaggatacatcaaacaataacatttttatc

SEQ ID NO: 219 - DNA, 136 bp, Homo sapiens
atttttaaacaattaaaaaaattggttaatagttggcgaagtttggtaaggagggaggaagcaggggcatttttacgcagatgacaggtcttactttttggaagatgaatgggtaatatctttgaaacccctgtaa

SEQ ID NO: 220 - DNA, 647 bp, Homo sapiens
aactaatcacagcttatatacactacctgactctttttaagaaatgaaataggtgtatatttactcactagtaaagatatccacgatatagtaagtaaaaaatgcaaggcatatagtgtactggatatgccaattattttctcaaagaatgtacaagaaactgataacactgtttgtctttgtggaaagggctaaaaactggagatagagagggagacttttaatttgatacccttcactagtgcttgaaatttcttacatttgcatatattactcacttttttttctggttttaatgtcagaagagtttatgtatgttgtagaattatgaactgctttatttttattttcatattttctgtattaaaaaggaactagtgaatattaaataaaaatgtgaaaggacttttcctatcatattgcatgaaataagagatttttgctggttggaacattcctatagagccatattcctgaagaatattttacacttgcttgatgaacatatcccatagttttatggatgtatgtcccatgactatgatgtgtgacttcattgttaagtatagaaaactactgagtaagaggtagggctctagacagatttagaagtttaactggaaaaactacagctagaaagagctatg

SEQ ID NO: 221 - DNA, 892 bp, Homo sapiens
gtgattgagggagagtctgtgagtgttttctctattgtcacagtggaaaggatgttttgaagtacctttacattttgaatagtttcaagatactgtgctaatcacctctgaagaaaaattaccttgagaatgcaaaatataagcagcattttgatgaatagcaagaacctactcatagggaccagaaaaatccttttacacagctaatttgcctttatcagtattctcataggatactgagttgaaagccacttgtgctctgtgaaccacctgagagttctttagttcactataggtctcttaatgtaatatatgatttcatcattcatagcatttcccaggctaagcttacatcatctgacatttaaagactatctttgctttctttttttttttaacatacaaaattttaaaattttgaactcatttttggtttggatttcatccactgctaaaggcaggtacaataacattttttcttcaacagccaggtttttcaaatctgtcaaaataattttcttgcacagtcagattaattctgagccagccacgtggtccaaagaggcctgcatatgtgaaattttatgaaagtacatttcttatatcaagcacttttgctgaatgtataatttaaattccttaaaataggcccatgggaaaagaactttcatatttctaaacatctgtaaaatacttaggtaatgcaagatggttagagaataataatgtccttttctgtaaacagcagttcttaacattggttaatcctctcatcctcctgcatcgtcatctttgtttaaattaatagtaccactatccttcaactcatcagttttgaaaattttcattaagcttgccttccttcccctcacgtctaataataacaagtttt

SEQ ID NO: 222 - DNA, 99 bp, Homo sapiens
gttctataaagtttactcccatgatatttcttaaaattatttctccctcctctaaaatttgagggtaactcatcagtttttggtttttttttttcttat

SEQ ID NO: 223 - DNA, 37 bp, Homo sapiens
attatctttttatattcatcatctgttatcttataga

SEQ ID NO: 224 - DNA, 794 bp, Homo sapiens
tgtgtgtgtgtgtgtgtgtgtgatttcccttcatagcctatagattcttttagaataaggtccatataaaactatttacatttcttcctttatctcatttagtgccctgtgtttagaaagtaccctgaaacatttggtaatagtttacaatcaaatgaatgtgtcacttctgagacaaaatagaggcctttatctttaccaataatcccttttgtaagagttaaggtatgtggatagatttatgagcctctttattctttaaaaacataaaagaacttgtgaacacaatgtattcatctctttcacatatgaaattcaaatacatttgccttggcattaaacatttgaatttgtatgtaagatgtcaaagttatataatttttctgttagagatggttgaatgtgctcactgggttttcaaattttctcacgtaaaagcggatgcagatagggacaaatgcactctctaatgtatggaaaacatcattagcctaccttacagaaaattttctttctcagctctgggacgtttataagagaatgaatattgtattagccaagtataggataacatgcaataagtttgtctgtcactataacagtttttgcttcatgatcaaacttgtattcccaggacttatgtggtgtcaaaagatgatgggaattacaaatccaatgctagaattacataaagtataatcacatctcaaagaattgctgtgaaaaataaaagactagatctttgccatcctttttgtatttgaaaaatcaatcagacaatcgctattaaaatg

SEQ ID NO: 225 - DNA, 305 bp, Homo sapiens
atgatttttgtaatctacacagctatggttaaagacataacaagtctaaaggtattatggggatataagaaatagcttatagaatcaaacagaaattaagaaaacacaatatagtacaaaaatgagtatgtgagtgttagcacagcagtgggtgatgtctagtctcatgctgatagatgaattaagaattaataggaaactgcccaggagatcaacacaaactaagcatctaattagataaagagttttaagagcagtcataagatattactttgatttctgccttaaccactactagcactgct

SEQ ID NO: 226 - DNA, 204 bp, Homo sapiens
agaggcttcaagatatgtaaatatggtcatcaacatttggctaattaatataatgtaatacttttataatcagatggcatttaagggtaaaatgaataaacttgcactttaaaaataaaactaattggggagttgtcatatttgtttcttcacttctatttgggggaaattgtcattaaatttaaaaaaattttactcacacac

SEQ ID NO: 227 - DNA, 131 bp, Homo sapiens
gcaaatataatcatgtcataatgatttgttttcattcagatgatatttttccttatttttcttagagaccctactcctaacccatagttataatttagtgtgaagcctccaggtttatataattatatggg

SEQ ID NO: 228 - DNA, 36 bp, Homo sapiens
ttttagtcactgattttcaaaaatgaaatccagttt

SEQ ID NO: 229 - DNA, 146 bp, Homo sapiens
gggaggccttcttaaccaagattagaaacaaaaccaacataaagagacattttgactggataaacgtatgcctagggaatcataaagtcatctgatatttggtagccttggaagaaccagttgtagcacagagaacagagctaact

SEQ ID NO: 230 - DNA, 284 bp, Homo sapiens
ctgcatttaacctgaagtcaatttgtgattgctgcaattaacttgaatttcaagacctgtcctttgtttctaatattgtttcctattactccaaaattattagttcctttaagctattctggtccttcttgtggtacttattatgttcataatacatacccttccaataatcaaattctgtcttccagtgcccattttaagaaagggaaaggaggaagaaatgaaggaagaaggaaattttagaggcattctttttgaatttctaagaatgacatacaagaaag

SEQ ID NO: 231 - DNA, 1634 bp, Homo sapiens
atggaaattttaacattacaatacatttattgaagacaagggattagatacatcagaatgtcatcactaaaagtggatgagtcccaccactcgtggactgcactgttcccaacatggtttgagagatggtctgctttgaggcagagaaatagtgtagataatcctcagggttcttttagcctcttttgttaccatgcagtccttgagctatcttctccatctagactttacaggactggaaccaggtatctaattgtggagggaaatgacggtgcaacattgttgcagatccaatcaatctcctttagatttagtctgttatcttcctttcttcaatctataagtgacacttttattggttggggctgctatacagaaaatacatacttggaatgcctttgtttgtttgtttgttaatccagtgagggaatgtcagttgaggaacttcaaatacctgtgatatttttcttacttgaaactagagtacactaaaagttaggattatagaaaccttcttactttttttttttaaattggtatctatgtttctcataagaatagcctgaatataaatataacaatatcttgagtagatttaagacaggagaaaggcaagttataaatattaatattagtgttacttttgacacagctagcctatcaacctaaattgctgttatcagcacaatgcgaatgactgccggccttatttcctcccgatggctctgttcctagagtcacagtgagcatatgtggaaatagccagctttaatacaaacacaaatgttttctctagctgtgcccaagacttgttacagcaatctttgaaaagtgaattgttttgccaagagaagacttaaactgtaaactgataattaataattcaggcatgttagttttcttttaatcttagctctaaaacacttcacatttgataaccaagtaggagtttccttaaagtaaacaaattaagttatgaattttgatgttttgaatttgccagaggcctccgaaggtccgtgcttgagctaagagtccaatcattcacttccatgccggcaattcatgctggaattacggcaaacagcataaactcggctctgagaaatggagctgggaggacaaagcaccttttatttttattgctttttgaagacgtgccatcactcttaccatctttattgtggtcatcacaagatgcatttattctgactgcatcttcggtggcctcacccatacacacaaggttaaacacaaatttgtttttcctgtcttctctgagtttaaactctgaaccacgtgatgattctgtggattgggtttaataagcagagtttacaaacagtggggaaaatattgtgtggggtgactaatgaacagaaaactggggaaagactgttagaattagaaaaaaaataacttctatttatgtcttactgaagttaagaggtgctttgtacaagagatgaattttagcaatattcatgataattacagcatgtttaacatgtactatattgaatgaaaatcatatatgtcatatatattatgtatcatataagatttaagtgttacgttctgtcagtttgcgaacagggttaaaatgtatactttctgtgtttttttaatattgc

SEQ ID NO: 232 - DNA, 31 bp, Homo sapiens
caatattgcttttgttttatagaagatctag

SEQ ID NO: 233 - DNA, 518 bp, Homo sapiens
gatctagttctgaagtttgttacttactcaattcagctgacttgtcttccaatttgaaacatctattattaagaaatagaaacaacacttgtacagaaagtgtcccttagatgaagaggaagtataaaaagattcagaaatatatcatttgtagatatatttagaagtcaagttacattttaacaatgcttttttttccattaaatataatttttgcacagtagtattgtataacgttttggaaattcaaaaaagtacaaagcagcaaatttagaaaaaaaatcatctggttaacatgttgatacatttttccccattttaaaaatgtgtatgatatgttcaaatacatatacacatgctgttaaaagctaaaaatgtacataatacattctgtaaatggaaatctttagggatgttaatggacttacataatcaaaatcctcctttcccactccccaagattttgtagcagtcctactgaagctgaatcctcattccacagttagttctcacggtag

SEQ ID NO: 234 - DNA, 1127 bp, Homo sapiens
aagccaaagcttttatgtatcactttcatttttttggaatggacttttctgctctctaatagctacagaagactattctgtgtgaggtttatgtcccttaagtctcatatctgcagataagaaaactgttacgaaaatcattcttcttgttctagaaaccttttattgttaaatattcttatgtcattatatagcagtttcatttgatctaatctcacttgaagataccaaaagcactatgaataaaaactttcatgagagatcattttgttttttattattacattaaagattaataaaaaccccaaactggaaatatcaggaagtattttatgtcctcttagctttttgaaactttgaaaaagagataatttacattcccaaagcctagcatatattggggttttgacaaatatttcaaacaaaaaattaggatgaccttctttgatatatttgaaataatattttgtgactaacatttattaaactctagctgaatgtaaagtcatcttttaattactcctgtcaatgggggaaaacattggcatggataattggaaaatggagatacttcctctgacagaggctgacagagatggtaggaaagaaacactgcttgccagttctcacactgcttcctggttcctgttgttcttgtggatggatgatctggtttgactaggttaagtgggtcatatgtgtaaagacaatatataagtttgccttcagttttcatttttcacttggtttaaaataatatccaagtggaaaatgtaagcaaatgaggaaacaactagtaaaaatggtaagcacagtgagagaaagataatcaagttaaaatctgaggtgtgatttcaatgttaagattagtaaatgtttaggatagcatcacaggcagattcctccatgcattttttaaacatccagggttaccttgggtttagacagactaatgttttggaaaaataaattattattgtctagtataacgaagaacatcaagagtccttctgttctaatatagaaatgaatgcttttgaaatttaaattgaggtgtgtgtgctagatagtctccaaagatagacaccaatttcttccttttctctacattcatgttgcattatcat

SEQ ID NO: 235 - DNA, 1765 bp, Homo sapiens
taaaacagtattctaattattattttccaataatgatttaaaaaatttatcaacatgttgtgtaggtataaaaatactatgtataagtatttataatacacacatgtgcacattggtttagggtatacagtttggcttttagcataagttatgactaattataaaaatgaccaatatgtacaaattttctggattatttcttttactcatgttatgatcaaaattaacttctgatttacattcattgtaatattttctcagtaattcaaactaagtggatacattaattttcaacaggaaacacaaaatatccaaatagatatgtttcagaatagaaatcttttgtgataagatgtgagaaatttcataaaaatacctgagtgagacaaaacaaatgtattttgtgttttgagattaagatatgagtgtagttgaacatcaatagagaaaaagtggaaagaataaagtttaagacacagagctaaagctttcagccttctcaaccaagtgaagactagcttcaaaaatcagtaaaacagtaccatttctccaccaaatttatgtaccccaaattaaatttgaaaatgaaaatacagtaataggactttgtgcattaattatgttagagatagcttcaagtcttgacatagcaggagccctcgagggtttctaggggaaccccaaggttattgcttgctgaaatctgagtctctggtgaagattcagtaagaaacagaggttacactggagctttgcttcttgaagaataacagatgagtagatagaagctttcgttctgacagcagaacgcagggtgatcagaatcccaatcactcagtagatgatgaaatagagcagtggaaggatgaattaagatgacatgctctgttttatcaataaaagtaatggcaagagatatatttctcacgattatttaaccaagagaaagctcccaagaatgatacattttgcttataaagcagtgtgaagtgggatagatcacactgtcaatttaatggctcagtttgctgcatttgtattaacagcaagattattctttgtattcattcagaatgaatgaaaacagagaaaagtgattctgactgtaaatctctttctgctggaaaccttttttcatcctatgctgttcttgttctttaggctgaaacaagtcagaaaattgaacaaattactctttgtaccaggaagtctttggtgttattcttatacctggacttaaacatgcattgtgttttccactagaaattaaaaaactcagtttccatttggaatgaaggatgtgacagctaatatgcaataacaaaattcagtttagggtaatgttagtgacagttcaatatgatatattttctgtaaagtttttaaaaattattattcccttataagtgatgtcatgtattcaatgcacatactgtacacaagtaccacagtaagagcacaatcaatgctcattcatcaataatcaatgagcaaatataccattctgtgtattgaatctgcaatagtatggttgcctcacagaaaatcaaattggaattttcttcttcctctgaattaggactttctcctaaacagccataaaacactattcaaggataaatgggagcagtgtttctttttgatggtaattttgatggtaattttgatggtatattcctgctggttgttactatgaaaactgtgttcactgtgttactctgtatgtagtatgtcatgacagagaatatcctgatggcccattgta

SEQ ID NO: 236 - DNA, 32 bp, Homo sapiens
tccttagtcaacattagttcttatcttaatat

SEQ ID NO: 237 - DNA, 583 bp, Homo sapiens
catactcaacctgtagtagattttgtaggtagtgaggcagaatggggatgccgaaatgcagagatagcaagtctttaaggcaatgatttctttagaatgtgcactactttttctctttaaaatgaaggataatatttattataagactgtcataaagagatctcacgacctaactttggaactactgcattcttatgaggaattctttagggtaatgaattccaatctgactttattcttagagaagtgtatctattggattactgttttacaccattcaagagcattggtgatgttcagcattttctatgtaaatgatcggatttctccccaactctctttgtaaaattaccttcaaaacccatcactcactgatttataacatctgatcaaattcttgattttcattttagtttcaagagcaaaagtataaaacaatttatctaccaagcaagagatataactgtaaacaggatgaaatgcgaatctagttatgactacagtattgaagccccttcagtgaaatccattgtgctgaggtagggttaaaattgtttgcaggatttatgagcatggtctatgt

SEQ ID NO: 238 - DNA, 235 bp, Homo sapiens
atgacctcactcattgttcaggtagctttggccttaggcattattttcttcaagatgctctctgaaccctcaacccgggacactttccccttccatgtgctcacatagcccatagccctgttaggtcagccatcacattttctgcaattgtatatttacatactggtcttccttcctgacgcaaaatgttctgtatggtagggcttaggttttactcatccacagtttcatccct

SEQ ID NO: 239 - DNA, 372 bp, Homo sapiens
tcaaatgaataaataaacataggttttaatttccatcatcagatgaataaaaatgtgcagaaaggctatctctatatttaaataacacttcaaatattttgacaaacataagaaagggaaaaacttcaattaaaggagttaaggggcttgctctcagctagctgccaagctgggaggaaaatcccacaattactgaaattttacttccatatcattactatagactgaggaagaataattttctggggtcctattggaggaaataaaatatgcctatctaacaatataagtaataacctatctaagaacataagtagtaaattttaagctcaccataaatattccaaatgagaaattgccttgaaactgaag

SEQ ID NO: 240 - DNA, 189 bp, Homo sapiens
gctgtttatagcttaacaatgagcttatgctcattatactattttataatagtaatagttttgtgatacctttttattaaatattgattatagttctgaatacttaacaatttcaatgaagcccattttgtttcaaaaactacctctaattctttccaggaatttttgctgatcctttttaaagtgttc

SEQ ID NO: 241 - DNA, 2191 bp, Homo sapiens
cttaactggattctaacatgtaactgaagtaataaacacccacagatagccttgactaacatgtaaacagttcttaccaactatgaacctcaagcgactccatcttgggcctgatttatgacctatgtgttctttaaccttaagataaatctgatagcctgtcttcagatgaaatattcatgaagtttcataacattcattaccattttatgattctttttagttggtataacaacaatcctttctagaactctattaatcaggaagcaactttgtaaatcactagcccaagtgtgtgaagccatcacttgttaatgtcttagctgtgctgcagaaatgtgctcaagcatagggtaaattcatgctgccagcgactctactatttacatccttctccttcaacatgctaatttgtttgggaaaattcctgtctgatctcttccagttctgagttttctgaatttgacaacttaaagaagaaatctgaaagccttggataaaaatgttactctctgtaaaaagtgcagaataagtgacagcacaaatcttttgtagattattagtagatcacatttcctggacaggcagaaaatgattttgcagggcaagttagacagaggaaaacataaacctcttctcaaatgacttcactttcctcttttatctcagcccacctctccaaatttgtttccagcatattagatatctttgatctcttattactgtactgggaattgacaagatttcaggttggtagtgctatttatatgtgcagattattacaataattacctttgaataatttttaaaaggtcaaagacatcatttctggtttaaaggaactgtctttttagttgcaagaatcaaaatcttctatgctatgtcactgaaaaatttcctaatgtctaatgtttatcatatcaatatctatatgtcatatcatatcattaaactttgaaatttaaaattaaagacagtaattcttattatgctgtttaaagtttttctaccttccttggaatcaagacttaggtagattattttcctttttgaatatgactaactgggcatatagtggatctttaaatagattttgcagcctgtctttctcagggatgttacatttaggaaaaattagagtccagaaatctaggtgaaaggtggtggtgatagtggaggagattaagaaataatggaggtgtcaggcaatttttatcatgatgaaaagtgtgctgacaaagaataaacaactccttcattgcgtatgctgtctttatcatgggatagtttagttcagaaactaatgggaaagccattttaaacctcctaattgctaactgtttttatatctattccactcagagggtgctatatggaagccagatggctgcaaatgttattctggtttagaagcgtcgagatttttgtattattgccaaagccattgtcaaaacgtcctatatcaaaacaaaacaaaaaataaaatgctctgttttccaaacttctgaaaattccacaatagcagtaaaatatcaacccccctgtagattttggcagttaaaaggaaaaattatccgtctctaagcagcttgttgtctgaactaactgagcagtagggcagccaaaaaaggaactgcatcattgagaagctcatgaattttcaaacaagaagcctttggaattcagaacggctcctaaggggctaagccaaatggactccgcacagaaatcaaccactcagaggattgcgtagtgactagaaaggaattgaaaattgctaacaatgctcaccatcaagcaaagggaaggtggcacctatgcaaagtttgggatccagctaaggtgtctcctagatactagaagcattggatcaaagacagttttaccttgaataatgtaaggaaatatcacaataaagtagggatgaatgatttcagccaacacaaggtggtaccaacaagcaagagaaatattactagtaatttcactgcatctcaaatataaaaagggcacactctattctaaaattatttgaaaagtgaaaggtatatagttgaaagtacatttcagacaaatggatgttgttaatatataaatttcaggattaaatccttatcagttctatgatctattaaatccaggtcttccaggccctcatctagaatctaaactatgttctgatcatttcttc

SEQ ID NO: 242 - DNA, 280 bp, Homo sapiens
caacttaaagggagattttccagagggtgagttggaaggttttttttgctcaaaattttaagagagcaaaattgcgttcttatattatcaccagatattgaaaatacacaatataatgagaactcattactgtttttagcattgcttcaatggtagagactgatctaccattgaagctccatgtatcttgtagctgtccgagtgttgctcacatatattctgctttccacctctccaagtgccatttttgaaatctctgtgagttaggagtgttggaggt

SEQ ID NO: 243 - DNA, 88 bp, Homo sapiens
acatctctggatctactacatggatttggaaaataagccagggctcaagaaacaagctagaggcatgagtctgcatagtcaagccacc

SEQ ID NO: 244 - DNA, 1080 bp, Homo sapiens
tttttttctttattaggttaatcaaaccaatcagctttataggatttacatttgtcagaaaatgttaatgagttgaaactaatgagaaatagagggggaaaaccaccaagagaatggtggcacagtttatacacttcaacagcaatatactactttcattaaatagattgttttatcctcgttttctaaatgatggatttaaaatgtcctgctaattaaactcaaactcgtctattgtgttctatattgcatctcttactaacaaaggaagcacaatagatacacattcatatgtgtctttgaatcaaaaagtgtgctgtatgtttactactttctgggcactgtttcttccataatgttattaataatagttctaataatagttccatgaaaacttaccagtttgaaggtgctatgtacatagtatagagtagatttcaagaaatggttgagataccccaagacttaaatcatgggttgagttctttcctcatctgtttcatttaagcttgaaatatctctcttctacttctcttttcttccttttctcttactattgtctgatactccggataattcctcagcattactccctttgctctccagagcagggacgttttgatagaagttgcagcacaaatctcataccacctcctttaccttctcaatgtcctaggccaactttcattttcacccactacctcacatacacacactccttagcattctcagagggatttaatacactttgaatcaatcatctgttaccttaaataacttccaaagcaaaatacatatcaaaccataaggtgttgtttctttaattgtatgggtgccataagtctctttgagaaaactaatgataataatagtaatatttgtcatatacttgagtacttttaatttgccatgcacaactttaaattctttttttctatatgtctcagacagaatagatggagtgtgcaaggatagatggtgaatatgtattttggtaaatttgtagagaaaacgaagaaaacatataattcactaaataatgataatatccaatgtctgttgggggcaaagagcctagaa

SEQ ID NO: 245 - DNA, 288 bp, Homo sapiens
atttagaagggtgggagatcagatttaaggcatcctgaggtcaaggtatatttggagaaaaaaaatactatttaaacttcgttcagaagaatgacgtagagttttaattaatcaattccaaacatgtagagggagaattaggatggggaagagaaaaagtacacccaaaggaggtaggaagggtgagtgtaaaacaggaaaggcagaatgaatagaaaggataaatagaaataagagagtggaaataaatccaaagaagtaagtaaacaaaataaaggaaaaaaaaat

SEQ ID NO: 246 - DNA, 243 bp, Homo sapiens
ttaggacactgcgttggtttgccaccttccccaagtcccaaattcaccccatatacactcccatcactcttgtcctgactttttcattggcttatctcagggtagtccttgatttgggtctgcactgcaagttgtattatctgcctctggtttgtggctttactcatattctcaattttaccttcacagtttcttaagcaagatttctcccttccagtatcttagtgaaataattttttttca

SEQ ID NO: 247 - DNA, 127 bp, Homo sapiens
ctgaaaactctagcagctttttgacaagtgttttgcttttgttgtcaattaatactgttaccaaatgatactcttcttaatttattcatatccacagtgacgaattgcacaaaattatccaaaagat

SEQ ID NO: 248 - DNA, 107 bp, Homo sapiens
ggagactgagtagatcacagttttaggaagttgaccctgagtcggtctgcctgtgtgttccagtcctatctaattagaaacagaggttacaaataagttcttcaaca

SEQ ID NO: 249 - DNA, 180 bp, Homo sapiens
taaatgctcactaaaatttattaactgaatggcttatgtgaagaaactcttgttgaattactggaagaggttaaggcaaacacctgtctttgataatacttattctaaaatgttatttataagcttggttatatgtatagtgagattttaccaagttatgatttgtataagaaaacattt

SEQ ID NO: 250 - DNA, 93 bp, Homo sapiens
cttttattagagataataagttcaaaatataaacaggtaaggtagaaatggtacacacgaataacaaacataaaagtacagatggaactgtgt

SEQ ID NO: 251 - DNA, 814 bp, Homo sapiens
gaatggcttcaaaagttacaaattgtcaatgacaaaatgtaaattgacactaataagttaatcacaaaattgagcccttaaaaatgatttcaatgttatattaggaacaaagcttcctttcctgctgtttttctatgtattcccagaaaaaaattcatagtttgtgtgataattctttattcaagcttgactaaaacttataagcaactacatagagttaccttggactcctctttatcgtttaacatgtggatgtaacattcaacccaaactcattcaagtacagaagggtgatgttttcttaatattagtacagtagagttcatagatagatgtttttggctatgttataagcccaaaatggcatgattaaagccattttacatttctctgcatgctggagtattttgtaaaatggctgtttctaagacaaatgcataagagcttctgcgtataatgaagccatagtcttcaggtaaaaaagaaaaaaaaaccctctagttaggcaagttttctctttatctgaaggtttgtaagttcaaaattaaccatttaaaaatgatcagaagattttaaattaatgtacgtttttatgtagcacatgcaaagtttaaactgtttcttagtgacttaggagtgatcatcatgactattaattacacacagatgctgtcctaggctcttttcaggcatttatgttgtaattcatggtactactactgtgagtcctccaccctccattagagttatttatttatgctctgccttatgctaaaggacttaatattccttaaaatacatcttaaaagatttt

SEQ ID NO: 252 - DNA, 249 bp, Homo sapiens
tttttttttaaatgttaagaaaacgaagaaatcaggacactgatgaattaagtagaatgaataagacgaagctggggacgatattagtacacaaagtacatgttgtgaactgctgcccatatgctggaagaaggcacacatgactagcaagcccccaaaacagggagatgtcaaatgggctgcagttgtttgtgttcaaaggtgcagaagaatcagaaccatttctgacactgagcaaaacttcccagg

SEQ ID NO: 253 - DNA, 221 bp, Homo sapiens
gtatcctgaatgtttagttacctttctcctccatagtgttgaaagctcctcaatggagctttccaatggagctcctcctaataaacatgctcattataaatctaaaaaactagtttcttagagctatttttatagcttttcctactgtacacacacttcaggggaaaaaaaaaaaaccagctttatagttgaactaacacagtgcaacttaacacctgcaa

SEQ ID NO: 254 - DNA, 652 bp, Homo sapiens
agaaatgtaaaatggctttaatcatgccagaaataaaggctgctctaattggatgttttgtctttgatattgtctctttccttgattaagctattagctatcacttcttacaactctccaaatacttacatactcaaaaatttccatgtgtagtgtaagttagattagtaaactagatatttaagcttattttaaaattatctaagtaaaaatatgatgtacctcatgtagacctaactgaatacattctgatgagtatgagatggttaaggtggatattaaacctgcttttctgccttgagagctcttctaccactccacatccagttactcaacaagctacagcatttcgcttctgaaatagctctgctcctgttttttagctgtctctttatttgggggcttatgtcatcttacatggcatattgcagaaataccctatttggtctctctgtcattacccttctaatccaacctttacactcatcttttggatacctttcataaatgcaaatctttctataaatacctaacaaccttggaataaaagccaaattcttttctcactcagttattcacacaaatttttgttatgtgtcatgcattgtgttggatgcttaacaacacatgcgaaatctttccaagattgtct

SEQ ID NO: 255 - DNA, 42 bp, Homo sapiens
tactgagttatcacctgcctgctttcggtgggcaataaattg

SEQ ID NO: 256 - DNA, 1324 bp, Homo sapiens
taagtactcaatccataattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatagaaataaaaaaataaattggattttttgatgacaaaaaagtatagaaaaaattgctggaaacattaattcaagaagcatctaggtgagaggaagcagaatcagaactgtgtttggggaaggaagcagtcaaagtgaggcagttttgacagtatgtggtggatagtctctctggtatgactaattgagaattgattgtgcatgcagaaaggttatgttttattaagggaaaccttttttcccttttgtcgttatgaaatccactcttctgcagatgttattcccttcccatactaaaccctcattaatttataattcaccgcattgctttaaaagtgctgcacagatttcctgtttctctcacatgcagtgcttctaatagagaaagtcaactcaggatataggttgaaatgctgcttgtcttgagggctgcatgccagacttgatggtgccaaaacatttcaccaattgtctcttagatcattgtaaaggtttcaaagtgctatttcataggctttaagaaagtgaatttacactctaaaacaactctttcactattgactgtaaattgactctggtgtttggaatctggagtcaaagtcaaatggtttcctggtgggattctcttaatttcaaggacaagaactcacagagagaagggtacactttcttcaagtgaagattctgagggcagaggcaaaagaaacacagagaaggaaatgaataccccttctcccatcataactcttctctctgccagtaaatttgacagaacttgggaaatatttgggtacagagatgtagaaaaataagtgaaaatggcttttcaatttttaattacccaacatgccattggtgaagataagaattaaaggaggattagttttcacatttcttttcattgattactactttactgatatataggaaataaaatgataaattgacaatttagatatatgttttcaatttaaacatcttgaatatgaaatgcctaagagatatatagatagaagcttcaggactttttagagatttcaagtaaatatg

SEQ ID NO: 257 - DNA, 31 bp, Homo sapiens
tggggtgaatgtattactatgaagtataata

SEQ ID NO: 258 - DNA, 282 bp, Homo sapiens
aattaaagtcttattgggagtaaaagacacgtaacatgttaagaaattgaagagtggtctaagccattacataactggaagtcaaattaaataaaattaagtgtcaatggataaacttgtaagtattctggaaagggagagatcaatgttggttgaggtttaaccaaaattatgtgaagaagtggggctttgcctgaaacttgaggaatgattggctatcattggcaataaacaagggagaaatagagatgatgcttagggaagacagtgagtagcttattc

SEQ ID NO: 259 - DNA, 91 bp, Homo sapiens
gtttattgttttatcttccatgttctaccacctcctatttgatcttggataaaacagggatacatagaaatattaattaattaagcaaata

SEQ ID NO: 260 - DNA, 562 bp, Homo sapiens
tatgttaatgctgtatacatgctttcccacatagagaaacaggtcagctccagcttttttacataaacattcacactagatacactttaattattctagaaggcagggaaattatttgagaattttcataatcctggggaaatatagtaaaaaataaaattttgaatatggacatactatatcaagagcaaatagttgtgccaatatttctagaagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatattttgaggagggtgaaactgatgtgtgccaccccaaatctttgattatatattttatgtagcatttcattgtataaagaaataatatacatg

SEQ ID NO: 261 - DNA, 1794 bp, Homo sapiens
ggatttctagtttcagcaaatgcctttatgctctttttaaaatatgacagtctggtttacaattgaagtacattatgtatcaaaggacccatatttgacagtgtacaaagttatgcgtttaaaaataattacactgttaaccaatgaatatgagttaatactgggaagaaaaactttattcaagtgttcattgcccatagcaaagtaaattatagaacagaaagttaataaaacatctaagttgatgtttcaaactcaatattacttttaaaacatcatcaagcagttgaaagccatgccaaagagattagttaaaggctaggtgactgaatacgatatatgtacttacaaagctttcattgcatagtgacattctgttcaaaacatactatgttgctggcctaacctttccatctgtttctcacagtcttcttatccaggtagttttccaagacatacggaatattagctatgcactctctaaatttaccttgagagagatcagatccatatcataagaaaaataaagtgtcagcatgaccatcttaaatctgtatcttggatattatttttaaaagctagtctttcatagctgacgtactacataacaaatacaatacattttaaccttattttcctgtgcaccttccacaaatccatactgcaatcacgaaaagggatacaaatcaatattcacttaataattttgattagaaaaggtataacccaaaggaccattccagtattgaaatttcagtaatatttcacctccctcagtcctatttctactgcatcagcacaacattatctcagctagcagccattaagatggttttctctttcatgttgatgctcttgcatacattttacagcctgctctgatggaatttttatcttcgcaaatgtatttcctaatttgtctatttctgtgtccagtaaactttagtctatagactaagaagtcaaaagttatagctacctttaagttacataactttagagacagaattttctacagtgagaaatttaacatactttcttaaggcattttggtgaacaataaaactttcttgttaaatttttgctttgcaatttacaagaattgggaatttggggtgatttgagaaaaagaggattattcaatggataccacctgcatcataaggctagactaattcttttgaaaggttaaaattggcagttactttaaatgatcttttgtcgacttttggaggtaacacagatgtctactacatttttcccagtgaatgtgttataaaatttaactgtagggtagtgaggctgtggattcagagacataataaagctatttggaaatctgggagattttgttttgttacagtagtattttccctgaagtcccttagtcaatagaaggaatgcaatttcctaggaactgcagattactttatatgggtgattgacaatttataaaacttgcatctttcctaaagaaggtttttatattgcacagatattttgttcaccacaagcaagattaaaataagctaatgaaatatgcaacttgttatttcacatttagtgactatgaaataactgctgctctcaaagaaccaatctgtcaacctccagaggactaaatagtgcatgggacaggggacaatcataacttagctagtcaaatgcattttttgtcttgtccgactatattattagatagtattggtaaaattaagatttttttaattaaaacttttactaaaagcttctatttcaaggaatttttgactatgaaatggaatataatggatc

SEQ ID NO: 262 - DNA, 517 bp, Homo sapiens
gtgcataatcctggttcccaaacagataaaatttctatatacaaagagtttagttatggggggtaaaatgaaaactttaaaagaaatattttctatttaacaaagacgtacaggtgactcttagttactcaaggtaggacaatctcagtccacaaagagattgtaagtgtgtttgagtcaggagcctagtttttcctttatattttctccttcataattataagcatattaggacaaataacaactttttattgcattgggggctcttgaaataatgtagtatgttttctaccatatagaaaactatattttatcataaaaacagaaaagttttagcaaggagtaatccttcccagaagactggatctgttgattaacagcattttaatgtgaggactctgtctttgcaaaattaactgcagataatattatggtggaattagttgacaagagatgaatgtataagacaacagtttggcagaggaaatattagtatgcatgccatccttgaagaata

SEQ ID NO: 263 - DNA, 230 bp, Homo sapiens
tagatattgtgataatgaaataaatgagaaaaaatagtatcacttagaagttagaagaggcaaggaaagtgttgtcaaaatagaaaaggcttgtgtatattgttcatgagctcaaggaaaaagatctgtggcaagaaagagctaaaagattcaaaagcaggagtagcaacgatgtgattttgaaagagtaaaaacatcttttctgaattgaaggtaacacgatgtgcaaa

SEQ ID NO: 264 - DNA, 673 bp, Homo sapiens
agtcatgggcaagatgggttcagcagaagatcagctgtggaatgataattagagccctagtaaaaatatgtagagaaaaagagataatagtaaggattgaaggaatggcatttactatgcataagacatttctgctcactgattatatgttgattggactagtttgttaccagttttagcagaaaatctgaaagtagccctctctagctcatacttcagttctctttccagctttaaataattaacttgtttacttgaatctatcaaggttgataatcctcagcaagtttaggaaatgttttacttctcctcctactggtttttttaagtttctacacctactggtattgtagataaacattagtatgtatttgttaataaaatcttctttcaaaaaatttgaaatttttacagtttttcatccttcacaaaagtatctatatttcagattaaatctgaccagaagtctagaccgctgtgcattgccagaggtaaatagattctgactttaaacacaaggaatgatacagcaagaaaaagacagttgttgccctagaagcagctctacaatgacatcactaacagtgatgctggtttctaaattgtcatctactccataaaacattaattttgcattcatcttttattgaaagcagtccttatacacagtttc

SEQ ID NO: 265 - DNA, 779 bp, Homo sapiens
gtaccatttatttcttggcccttaagtgctagctcaaagatcatgatgacttattatccctgctccatgattatgtcttcttaactgctcaacaatttggaggagctcctgtccttgtgggtctagattcccccaattttcagtgcttgctccacctagtaagtgtctttctgtgcatcttgaatgttctccaagagagcgtggatgaataagccagtgtcactacatgcttaagtgcaaatagcagccatttcagcaatcagggacaagagatcaggcaaaagcattctttaacattgtgcgatcttcacatttttatttaacgattactgatttattaaagctgcatatgttcagaagattctgttccttgtacaagaagtgtttaagtgcttttcttatatcaatttgttctttctggaatttttttttaaatcttctcttccaagcttcattagttatcaaaatcattctttttcatgtgccaggatgtggcccaaaggttaacttgtccatctaacttaatcaagaggtgactgtactctggtatccctgagacatgcagaattaaaaggttataaaccctgaatgtttagaacattgtttcagcacatattaattagtgacaaatgacctgaattgattctatctatatccagttcaaatgagcaagcagatattcgacttttagcttctaatgctagaagcctggatgttggatttttttttcacaaggagactcagtgtctagtttcaacagcttgaacaagttaggcttt

SEQ ID NO: 266 - DNA, 1660 bp, Homo sapiens
tctttttcatcatttctattgagaacagaaatgtttatctagtaagagtttggtgcacttgtgggtggattccttcagaatgtcagcctacaaattaaatagttatttcgtgaacatggaattacacaaaggatgatatttttatctagtacaggattaatggattgatcttctttaacctagaaatgtctctgcgtggattgctggtattgaacattattagccttaaagagcctcactcatggagaatgtgagaggcacacagggaaatgttgactatacggcgctcctttttaaatactcctaatgagatgttaacttctcatattataatcttacttagaagatgacattcttagtttatttgactcctaaacttttgggacgagtacttaattagaaaaatattataggatcttcaatgaggtttggagataccttaaaattatcagaagtgattagggtgtggtttctacattttcatgttggttcttactgactttaatttctgatgattttcaaaccctgaaacttattttgtatcttcagtgtacatagttaaaattacacttaaaaacaattaaaatgaggtatctcattttgcaaaatagcactgtggctcatgtaatactgtacatttttaccactactgccttcaagcacttataaaacttctttcctcatttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcaataggggagcgtctgattcagactaaacatgtacctgcaaattagtcaagaaataatgagacaatctgttaccaaactcttggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcataaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacataaagataatgtccagttcagttcagttttgtggtgtgtttgtatttaaaatgtgaagtagcgtgtctatatgcattcatgtttatttgaacaaatgctgtaagtcccctgcaaccttttagttaagtattgtatttttctgcactagaactttatttgatttttattttt

SEQ ID NO: 267 - DNA, 314 bp, Homo sapiens
gaccaaataaataactaaatgtttgtacaaaatgtactatatatacatatttattccacaatttgtagcttagaatttgtatctgtagggaagttggtctatttggaactctgaaagcagaactccactccaaactttttaactgctgttatcaccttctggaatatgtccttttaatatccctcaaatttatttcatattatcccagtttatcaaacatttaggacccaattgtagtcgtaaaggaatctttttcttactgttctagctgacagtgcaatcatcatctcatattggaacttaaattccctggc

SEQ ID NO: 268 - DNA, 1500 bp, Homo sapiens
tattagcatggttgatacctggtaactattcagcaaattatgggtgtaattatgggtttaacgtctgtctacaatttttacttaaattgaaaggcatgcatttttcaattgctacctaaagtctcagaaggctgcaatcaagtatgaaggccaagatgagaaagagtttatgcatttacttgataactcaaaaaaaaacacatatggtaaattattcttttgtgccacagtaaatactgaatatattggtgtcaagcaatggcttaattaataggataagaaaccatgttcatagaagttaggaaacaagtgtttaggggttaaattataattaaaataattgacctcttaataactgaaaatggtctgtacctaaaaagttggtataaagttattataagtaggattaactatcattcatcagcattttgtaacactcagatttgaaagaaagagaaaaagagagcgataaacaggatttattcacaagagaaccttctgtggcattttctgaagattagaaataatcagttctaactcctaagacaacctataagtgtaaaataataattgatatttataatgatgattctgagttgcacaatttaactcatcaaatatgttcattcccttccatagattatacttaataagccaagaaggggattctcaatcattttcaaaagatttttaataaggaatgaaattttaaaaatgttttcctccctggtttactttaaattcatgaggaaatttaatgagtcagatcatcccatttccaaagcattgcactatttgttagggtatacttttttaaacctccaagctgctctgtgaaaggttacatttatttttatgctaatttcctgtccttacactcaacttcaactgccaaaaaggaatgagactgaggaaaggagaaagaaaacaataggaaagccatttattcttatacatgtaggtcaacttattggtttatcgtcatttaatttgaatgtcacttggaagattttatagtgtggaacagatcgaagttgaaagtgtggggaataaaattttttattgttcagtaactaaatagttcttttttggaagccggaatttaaatccagtctggtcaaactgttaaaagaaaaagaaaaagtaaacataggaaaaggaaatttatgggatggaaaaatgtcattttctaagaacttcttggttgtaaaaatcctgattattatcccacaaaaaagtgcacaaatggaaaatgggtccaggtaaaaggggtcaagtttagcaagacaaatttgatggtgtggagagcttccacgtaaatacgacttcattttagattagttatgttctggggtgacgtctgttatggtgagatagctcacaaaattggtgctggagctgatcagctgcgaagtaataagaaaataattcattttgtgttttttaatgatattattggattaatcatgaaaaacgactttttggtttttttcaaattta

SEQ ID NO: 269 - DNA, 473 bp, Homo sapiens
aggcagtgctactgatgctcattcctttatgaattaatttctttatttgaacttttctggttgggaaaggcaatatacatagaaatcactaatacctgagaagaattcatttccctaattgcttccttttatggaagaagacagactgggaaagctttaaattctaaagtttaagtcttttagggcttgacatgacatcacatacccctttggaattaataggaagacaagttgccttgataatcctaaggttatcatttctgctgtgaagcaggacaccagcagctagcaccctcttaattgttgtatcaacttaagtgtatgtaactcatttcctcttattctgtctagaacaaagaaaaacaatgtgacaatatacctgttttatgggtctagaaactgaggagcaaataggattgtaaacatgaaaagatcattttcaggcactttcttgttccaggcaaggaacattc

SEQ ID NO: 270 - DNA, 361 bp, Homo sapiens
gaataatgtataaaaatgattagtggtgctgtgtgtatataagataataatgctaataaggtgggcccatagtaattttttaataactattctcttttaatacaaaaatatatactgcaagactcacatgttggttggaaatttccctcaaatcacctactgattacccttgatttcccattgtttttagtttctcaaaactaatgaaatgaaatatagcagaatgctaacccatataaaaataaagtgtacccaaatattgtaatgtaaaaaatatatatatattcatatagtagagccagaagtggagttcaagcatgtttaaccaaataagagttttaatttgcagttcaatcatggg

SEQ ID NO: 271 - DNA, 913 bp, Homo sapiens
ctttgttatatgcttagagtttctctcaaagcacattatgactaaggagtgtgtgtatagggctcccatccacaggatttcatggcacattccatcttctacaccactctaacccactgaagtcctagaaaggtatttaggtcaattaagccactagacaatgtgagctgctgataataaggcagagccagacagttttgttttgtttttttttttaaagttaaggtggctgccttcttgtgtctgtcacatctaattattcaaaagattactgccaaggttgagccatgcttttaagggtcaaccactacataattaccaactccatcattatgaatatgtacctgtggttccatcagtgcctgtgggtctatcactaccacaggtagtagctaaattttgtagcatttggtttcattctcagtaattgggaaagtatcctttgaggttttagcaattacccaaagcatatgctgtttttccaacaacatcaaatagattatgtagactttgttacaagaattttgatgctgttctgttacttgccctcccataattttgaattaaagatgtaatcaggcactgaatagaactgttgatatgcactgtgcatgtcaatcctctctgtgttatgcatgaagcaactttgtgtgtttgtgtatatggtctgacttcttccataaagtaattcttagactagattgaggttttatatgaaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgcctttactgacaaatggaaatattcaggcttaagccttttcttgc

SEQ ID NO: 272 - DNA, 115 bp, Homo sapiens
ctttattatcattttacattcaagggcaatctcttttttttacgtatgaaagtaagtgagatccatctactactttgaaaatgaagaaagttgagatcattgacaatgaacatac

SEQ ID NO: 273 - DNA, 533 bp, Homo sapiens
gaattactgtctttaaactactattggcttactagttgttgtttttttgtcacatataaaatgctttactggttccagttagtatatttattcaactgccaattaaagattatccctgtgtaaaaaaaaaatgaataaaacaaacaacaaaaaaaatcatcctgtagcagctcaatttgagcaaaaaaaaatttaattatctaacaactatgtggttgagatgtggctggtgggttcatctcatcatacagttcgaatatatagccagcatcacccatttagtccctgcagtggctgaaaacctggcaaggctttttctaacctgcttttctccttgaagatatttgcttacattgtcaataggctaagggggttgttttgaagcctggattttgaatttcaactgtcaagcatagtctattaatgtagaaggttttaagtttatagtttcctcaatgaatgcattttaaaatggtacagataactctatataatatcctccatatgaatttagtttatatgctagcaaaatt

SEQ ID NO: 274 - DNA, 89 bp, Homo sapiens
tgtgaacatacgagtgttgctcccaatagggaggaaggagagactatggcatcttctctaaatcttctttttatttatccttttgtttt

SEQ ID NO: 275 - DNA, 200 bp, Homo sapiens
tagttaaactttttgacttttaaaaataagtaacggttgttcaaaggtctttagagcagaaatgagagtctcagggctccccaaatctctgcacacacggctttcagagtggaattacccttgctcacacacagctgcacacagcatagctctgatggcagagggttcacttgctgcggtgaatgtcctagaatagaagt

SEQ ID NO: 276 - DNA, 1434 bp, Homo sapiens
ccatggacttgtggaggagaccatcatttgatgcagttggccacactgaagctcagacacgccaacgtggtaatgaggcagaacgtggattccactccatccttttaagattaaagacatgctcagcaacaggtgatactagttcaagtatttaccgggttatgtgctgggtgagctggtgagcctgcagtcccaaaaggaagaaaaagagaatgaacgcagcagccagctgcgggagaagcaaccgtgcagccatctcgggttggggggcaggaggtttcccaggggagctgcctcctggcaggaagcgctggaatccagctcagtaattcccatgaactctgtttaacaccagcaagatgggaaaggaaggcagctgcagccccagctggagagcagggccctgaggctgggctcttcctgggcacaagcctctgcccagagcttcctggcggggccctcagctcctcttctccaaggcctggaaacgagctccatggggctgagaatcatctctgtgtgtgggagacacatggtcaatctgagtaagcggaaaaaatggtgagtggctgcgatgggaaggaagccccagagaaggggctgagcctgactggcaaacgggagggcgtggagtgggtgggcagggacttcacttttccttgacagttgtttcattgctcagattattttggcaaagcatattgttgacgaatttttatgtttttctaggtatcaatataaaagtaagatataaacacaactcctcaacaaaattaaaacccacagaaagggaacctcacatttcactcccacctgtctgttctcccctctccttgagaagtaaaaacaaccactgtcttgcagtgtgttgctgcagaacttttcttacaaagttacctaaatacggtggcttcgaaaaacgtgcttagatttatgttttttacttaaatggaaacgtattttgcacacggttgtacaacttttttttgcatatttaatattcagaaatatgtcttggcgttgagtttcgagatggcttgtggcgagccacgccgtttgccctagggctgcttggttaccatttgttgcagggctctgtggttaccaggagcctgtgtgaccactgacttcacatctgcccttcgctgaacgtgtatttctagaaaaatccagtgtcaaacttgtcccacactccagtgccagaggtgctgagggttctcttgggcaggaccgttcagcaaagtccacagagcaaaatgggagcttggccttaaaaggggtgagcaagcaggaggcgggcctcctctcatgagcaggcacggaggtgctggtctgccttcgctggccgagtgcccgctgcaggctgggctggtgggagacgtacggacacaaacacggctgggaagcaggctctgcctccacgcagcatgctca

SEQ ID NO: 277 - DNA, 617 bp, Homo sapiens
cccagctctctgggttcccagaaccctgtgggagggctgggtcgcgcctgcccccttttaaacacgaggcttccatggaagcttcttgccggaggctggacactgaggaatggacaggatcaacactcttccaccggctcttccacctcccgatcacttccaccatcgctgggggaagaacgaatgcaccgcgtggagtgcttccgccacaaagcagcacatcacctctgctcggagaccctgctggtgaccctcagccagcctcataggccacagcaggtctcacagccatgcccactcgcagggaggcagggaagccccagcccccaccggtccggcacaggaaggagacctggaccctgggagtgccggtctcgcctcccactctcctgggtgagtgacagcgacgctgccaggtgggtggtccatcagttagacctggtccgtgagtagcctcctaggtggatacaaacatgacagcgtcccacagagcacctcgcctccttctggaaatgcatagacagctcctatgttcttctctccatctgggcatcatttactcttccttcacttgcactgctgtccccagttgatcttactttaaaagtccctcagag

SEQ ID NO: 278 - DNA, 244 bp, Homo sapiens
cgtctttcagttcattggcaccacaccttcaggagacagggaggacattggcaagacagggctggcatctggcagggccccaggccacccgtaggtctcgcgagtgcagggacagctcctgacaggatgaccctgccggcccacgtgcccactcctcctctctctgcagtcgcctttctctgtgcccatgaggacctgctcagcccacctttgggtggcttggaagtgcctgggatttaagtcc

SEQ ID NO: 279 - DNA, 435 bp, Homo sapiens
gatgcccaggattcctggcctggttctgcagaattcttttattaatcacttattctggactgaagcctggataggtaattatcagccttagatttctactcaagcaaaattagcagaatcccacctttccccgttggatcaagcgtgccatgaaatccatgccttctttattccttcctgttggctcctgtgccacgctgccttgctggggatttgtctgtgcaattgtcaagaggccacgactgtgtgcccacgtttgcatggcacgtaagcacatcacacccaactgcaggcatgcagccggtggtcaggtctccccccagagcactgcgtactgcagaaacacacccagttttcatccacgcaggatggcttggatgccccctgcccgtgcccagcctcaggcccctcctcgggttgcctcccctgcaacca

SEQ ID NO: 280 - DNA, 345 bp, Homo sapiens
ttgccttggagggcctggcatgcttcacacacagcactcaccagcctgtttcacacgctcctacgcagtaagggtgtgagggcagcagcacctcttctcctcctcaccccagggcccaggctaagggtgctcgggaagcatcagcaagccatgctgggggctgtcaggaccctgtggttctcaaaaccacatcacccaccccgtgagagatcagagacatggacagcacacgctggctgaaggttgcagtctgctgagggtcactacagcggtgccactgacccatcacaccctcccacactgcctgttcaggtagtgtatgcagacacacgcgtatatatgtgg

SEQ ID NO: 281 - DNA, 784 bp, Homo sapiens
gcttgaggaaagtcctctctcttgctgaactattctcagccccagtgcataacaggtctcctagtggggtctggcttctgacactttcaggggcccccgtgacagacactctagtgcatcaactcctcacttaagaacggctcgagagagggcttccctttcactgcacaacagaagcaggctcttcgcagagctggttcccttttctttcaggtaataacgctctccaccttcttcaactggccagacgcctgcgggctgcaatgcccatgtcaagctgcttgcagaggccctttgtgagggtgaatgggcacagcacagagttcacagcaacacacaccggcgtctgctccccctggagaagtgatgtgggtgctggggaggagctttggccctcatgtggccatgctgccccctctgccgccccaccaggcctttctgggtgaccctgctgcgcccctgctgctgatctgggcaggagggcgctccccccgcgctaggcttcttgcgtggtctcctgtctcacaaaactcctttctgggagaaggggaggtgtccctggccaggaggaaaggagccgtgagaaggctgtcgcatctcagcatctgctctgggttggactgtgctccccacccccaaattcatgttgatgacagtgctcccccaaggcatggggctcactcaactatgaatcccgatgaccagggaaggaccagcccactccatccctccaagtccttaccagttgtaggtgtggtcatcctctagcaaggggagctccttg

SEQ ID NO: 282 - DNA, 1969 bp, Homo sapiens
ccacttcttccaagaggctctaagcagcctcacggagacatagagaagtcctgcccagcctcacccagcaccatccaatccctacctgcagcctgagttcagagagaatgaatgaactaagctattcggaaggtctattttaataggaaaatgttttttagttggaacgttttggaaataagataacgcaatgtcttctatagttactcatttacactgaaacgtgatgggtaacttttagggcgtttgcttccagtcactttcccctgactccttgatgtgataattccttccataagatacaaccattctcccaagtgatgcgatgacgagtatgtgcgtgactctggagggaaagggtctacatctgtctctgcttgtgcctcggatgggttttacagtagacgtaccaccgaccccgcctcttcaccaggtaacagtccttgcagcgcttcttaaggacagtcttgtttttgaaccccagcgcaggcagcagatggggcaggaggccgggtgagagaagtgagcgcactgctgccccgggttccacagccacgggggctgcacctcgaatggatccaaatagaaatgtggagagggctcgaggcttcaccgtgtgacgactgagatagagcagagggttcaccattttccttataaaaagatttgccatgttgtggtgaatctatgggagagagaaaaaaaggagttatagcttctcctgcacttccacctgctctttaaggcttccttttctctgtttcactgaggcttgggaaggcagggacctcggggactgagggtgttcccataccagctgcagcctcgacctgagcttgaacactgccttaatcagccaagtgtgccaggagaataaggggcagtggacggtggcttccttccctttcccgcctgctgcaagtgtaggtgagtgtgcaaagccctgcgatgttgaggagccgctcacttggctgggagggagcttaaacttaggccgcatccctttccaaacagacaccaggtcaaggacggttcaactgatgagctcctccctccaactcttcccagacccaggggccctccctcgggccagtttcgggacaggcccccgctccggaagagcacggaactctggcaccccggtcgcccgcccctgcttccccacgcgccccggcccttagggttcagcggccccggctgggaagagctgggcctgcagggcccggaggacactgcggcaccggagccggccctgcgcgcgggctgtgaggtcgcgttcgggagccgccagttctcccgccccggggtcgctggacaccccctcctgtcgccaggtcgggcgcccacggtcggacccgcaccccccaaccctggccctctgagaccgccaggccccggcccacgctcctctgaccgcagcccactcggggagacacgcccgagggtcccaaggtggccggccccaccctctcgcagcccccactctcaagacacccgggacccctgacctgagaagacggctcccttacccggccgcacgctctcacccggcgccgacccctgcgtctgcgcactggcacgcggacgctgctgccaggaaggaagatggcggcgggggggggggtcacgtggcgtgcccacgtccagtgcggggcgcagagacgcagcagcgagtgcgcaggcgctggagtgcgacgtatcactccccgactgcgcgcactctgcgggccaccgggatcgtcgtgctgtttggagcgctctcgggaaaaaaaatgcaaaaaccaggaacgaaaatggatatccgcaacgaaaaagaaattacaaccacttaggccttagaaaaaactggcaaataccaatgtcaaaacaaactgagaaagaggacatgtttttaagtggacaggagaaatgtaaacaggctccgggaaacgagtggagacgggcagtagtttcaactggttacggctgt

SEQ ID NO: 283 - DNA, 2075 bp, Homo sapiens
gtaactccattcgccttcctttttgtgtgtgtccgggtgagttgcagacgtggctgcgtccactccgcgctccctgcaggccccaacgcttcatcgcagcgcccactttttccacctgacccggcgaacaccgggcgggccgctggagtttatcagctccaggacaaatctgcctctgaccaccacgtttgctgggacatctttgggaccggaggttttcatgtgcattcttgtttctcatgcctttcctcctctttatcatcttccccgccactcatccatctctagtgttttgttcttggagtcacgtggtcctcaggctctgaccacagcaaaagaaaagctggatgctggagcttaagctgggatttatacccaagtcaactctaagcaaaacgggcctttttagaggctgtatttgcatgctgtaaaatcagtcggtgtactaggctttgttgcagaaatccccaatatacgtttcctctgcggctccccgtaaccacacacaggaacgcttgccttgaacgaggagaatgcacttccagtctcgtctgctaagcagttgactccttcacccaataattttgatatttaaatgtctcatgattatcggttaccataagaatataaacaatgtattttcagtttacatcctcccctgcctgtccgctaaataagaaccactgggtactcctaatcgctgaaggtttcgcacaccattgcctgcctcatcagggccctagctctagcctgcggctgcaactgcatgaggctgcacctgccggcgcaacggggccgcttaacttttaggccattgatgaaaagtcaaacaagcgcacagtactcggtgtaatcaggggcatttttagcgagatacctgggatgaaaacgggtgaccacctgaatcagagagcagctccggcgcaccctctgccccgacccgcgctccccgcccccagggcgaaataaataccgggtgtttggcgccgccagaagccgtgcgcatgcgttagcgctaagcgggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtaacggccgctgggtacaggatgcaccttcctccagccgcacctcgggcgactggtggcagtgggctcgccgggcatccgcggccctggttctgcgccggcagcgcaggtcgtggtaaggttgtgctgtcgctcacgcgccggggaggacgcccgcgagtcgggacggtggtggcagcctgtagcggtgggtctcgtccttccagggcctgcgggctctggaacgggaagtctccccagcgggcagcacttgctgtggactggctgcccataggcgatttgtggcagccgattatttgggtcagaacgtttagaatttgtgtaatattcaataataaattttagtaacctgagaagtcggttgtagtccaaggcacaaaaaagccctaagccaaaatgaagaacaaaggtacctgtgtatactggaatgtgccctagtagatttaatggggggatagtaaagctctcaggccatatgccaaagaaggttgggggcggttctcctcggtcaggatttgtctctcctccttagctccaccttcccgggctatgtctctgtgctgctctctgatccaggtgaccacccgttttcatcccaggtatctcgctaaaaatgcccctgattacaccgagtactgtgcacttgtttgacttttcatcaatggcctaaaagttaagaaaaacactttcctgtaatatttatgattgatatgaagtgactttcagaattaggccgtaaaagtcacacatggtctttttgtttttttccaggtttatgatgataaagactacaggagaattcggtttgtaggtcgtcagaaagaggtgagtaaaaaatctagtgaagagaggtaagctttcctaaaacttttatgtaaccaacaag

SEQ ID NO: 284 - DNA, 854 bp, Homo sapiens
ccccatattgcaagcaccctaacagttctggatggggttcttcctttcttaaaatcttaattgtgtctatttctgacttgtttccccctgaaatacataacattgtagccgtagttctggtttgcatataaatggaagtgatcttttttaaaattcttgtcccttattctcctgagactctcagatttaagtaaatcatatcaactttaaaaaaattattcttttaaccacctggaggtgtgttttttatagttttcaccaaataaattagtgtgtgttttttacagggacttacactgacaagctgaaaatggcacatgagtttttcttcccttagtgggtctgttagctctatgcattgtaagggaagatcagttcaggtgcctgtgagtgaccactggagaaagaatgttgaaattagaatccttctgcctaaatcagcctattttttttttttacctgactccttctctatcactcatgtcaatgagctcctgaattcgtaattagatcaggcatgcctccatgattcctgaatttgcttcctgaaggatgctgtgaagtgtccttcacagccaccttattcattctttttcccactttggttagcctggtgttcttcttgttaacaccgtagctatccctaaatcatgtattttcccttctccttcaatcttggttacgttatccattcccagtgtgtagtttttgtacgtctattccagagctacagggcattccagaaaagctcacatgatcatgaattgactataaattcacattctcaaaattcagctggttcactgttgtgtggtttgatgggtgggtgtcagaaaagtttgttttatagtggt

SEQ ID NO: 285 - DNA, 1244 bp, Homo sapiens
ttgtgtctggtgggtttgcctctcggagtagaagctgtgtggacttgcagtctaaaaattgtgaggttgaatcacagcatgggttcagttttctcatttgtgaaatggaaccatgtgaatatttttaattgaatcataagtctccagtgatatcacactgtcagttgtcgagtaagtggtgtatagggtaagtgctctttctctccatcctcagaaacccttttctgtttgttgtttgaattgttagtgtattcccagtagaagcatctgttccatgtgccacattctccaatgctgtatcccagtgattcacacaaaggagctcatggcattgcgaatgggacatttcttccgtgtgcaggctgtcctgggcattcttgttaggtatatgaacttgacatttggaaggtggaaaccgatggatgttgaaaggatttgcaggccctttggtttcttttggcagtgatcgtggagaaggggaggtttctcttagtgtggatgcggtatggtttcttttagtggtgaccgtggagaaggggagaaaccgatggatgtggggagggttcgcaggccctttggtttcttttggcagtgaccgtggtgacggaggtttcctgggcatcgatgggtggttgttactgaggtagtggctggactctacatccttgctttgtgggtgttatggcacggtcgtgggggcaaggtaggagccccagattgagcagttctggagcagattggtcctgaagcccttgggctcattcatgcaatctggcttccagcccagctccctatctcagctcttgtagtgacgaagcaagtatgtgggtccctgtcacaaacgcctctctgctgaacattctttgtgtagcttctggtttctggttggtgtagcatagggtagtgggaaacaacttaaaccaaacagaatcaggattggcgaagccagtgaggggtgggtacgggatagtgtgatagtagtgtctgtgaccggcagctcacccagggcgtcctggttgtgacctcaacgctccagccggcctagcctccagtgccttcccccattcagcatcctgagtgtccagggcacgtcttggcctcacaccttggaggttcaaggcatgttgataacatgatgagtgggcatcctgcccaagctttccttctttcaacacaaatttggtgtttagtactatttttagtagtagttgtttggcttctgagagacttaattttttggaaca

SEQ ID NO: 286 - DNA, 25 bp, Homo sapiens
aagtaatactttaagaagtaaactg

SEQ ID NO: 287 - DNA, 1296 bp, Homo sapiens
ctgaatctgaacttcacctgtagaacaagcatagcaggaagctagataattgagctggtctttgcagaaaaacagtggaaagtatctttgtgtggctcctgcccagctttgaccgggggtaccttcaaaggaatccatggcccctgggcctgtgacgggcctgcctgtgaggagactcctcacgtgctaaagaatgtgccagccacccccagccagaagtcaggcctcacatggtcctggagcaggtggcactctggggccacataagtcagatgggggactggaacaaacttggaagtgaccaggtatttctctgctgttgatggaaatattttcattgctttatagtcgtacaagtaaaattaaaagcagatatgacttgtcccctaatagaagggatgactgggggaggtctgcagtgaggtgtggtaataataacagcaataacaacagcctggtagccaggtacttggcgacatcatttgcttttttggttagtagctggggctgccctgcctggccgcatccggattcaggctcctgcgctgatgggcttatgagggctgtgtgcttcagtgacttagcttgtaggctcgtgggcactgagtccgtgtagatgaggaaaggcttggagcagcgcctgtcccagggaagcctctagtgtgtgttcgccttactctgctgctgccttcgccaccaccatgagggcaggcttcacttttagatttttttaaaatactgaagttaaacgttagtgtctatacacaaggtctttacttttagtttttgaaaagaaggaattaggcagcaaacccggaacatcaggaggctgggatcccttgagtgcgactctgtgccacccctctccacctgtgtgtgtcaggatcacggaacagctgggggcttcagcttgtgccttcatctgcccgccagtgggatggattctctcctcagatgctcggcagggcggagtcactccctgacccgcacagcccacagctgggcgtttgggtcagcgagattctgcacgttttctgagacacctaggctggcagggttgagtccagttgtgaccctgtggcctcacctgcctggccctcagttcttcagtagcagacttcaaggtgcgtggtgccaccaggattaggagcagttgcacgcggtgcaaatgtctacctggcgtgctgttttgttgcgataatgtgaagttttatccttctgagaagagtgtgtagatttcgttaatggaaataattgagtagtgctcacgagagaggaaaactaccaagaccctcc

SEQ ID NO: 288 - DNA, 109 bp, Homo sapiens
gcttcttagaagtactgtatgaggtactcagaggtactgcgtgaggtactcagaggtactgcgtgaggtactcagaggtactgcgtgaggtactcagaggtactgtgtg

SEQ ID NO: 289 - DNA, 343 bp, Homo sapiens
aattaagagggaagtggcttcaggcccacgcaggaattgaccagaggttcctccctgaggcttctgtggctggtgtcgctcattcttatttctcccaagaggccggcagggcagggcacactcgggtggggaagcaagtgaggctgaggctgggcccacgcggcacctccagaggctctgcacacccgtggtggtaacttgtgttatcacccaggacaagcgcactcctcggatcagcagtggaagaaacttgtgacatctttcgtctacattgagccatctcttgaggccagcgcagcaccacccgaaccatgttggctctcgtgcgtgcacacacacactg

SEQ ID NO: 290 - DNA, 2828 bp, Homo sapiens
agacaggactgggagtcggggatgggtgctagggtgaggcccccagccagacagtggtggctgagaaggtcctccgtgagaggaagattgaattgaggggcctcggaattccaccctccgcctttgcaggtcatctggttggtggcagaggtggagctctgtgcttgcttccaggttcatccttagagggtttaagaggggaggtttgcctgagtctctcttgtcttgaagcaacctgggcgtcctttagggggtgtttgagacgcgggcggtgcgatgtgcgccatggctgctctccagagcttttgtgtggcttcccgcttctgcatgctcctcctcctgagcttccctcccaaatacgccatctttatagtggagtgaaggcaatcggattttaaaagaaatcttctggatggataagaaccgtgggtctttgcttcctttagaaaggcttggactgtcagaaataatggttataaagtgaggtttatttatcccaggacccagaggaaaatagttggaactgtgaattcacgagccccaggttcacatgctggtggctttgtttgtgagctggcgagatgggctttatttcctccctcatgcagctccccagcttcgtctttgcttctctattgtgtctttgtgtcttgtggttctttctcttccaaggcactggcaaaattagtcactggattccaacattctcaaagcaagtttgaacatgttgtacagacagctcaattgtggtttttagagcattttctataaagttacttagtttaaaaattaatttgaatgaaaacttcagttttgcctgtgatttaagaattatatacttatatagacatgtatacacacgtttagcttaaataattattggcattcatgttcagaatgcctgatgttctaaataattgaactgagcttttactttattttaaacttttattttaaatgtccatgaatggggtcggtattctacagtgtcgatgatccagctggtggacttttcccttctgcgttggttttgatgctgtgtcacagaatcacatattttatgttttatctttaatagatgtaatctcagtttgacacaataggactttgactcctaaagatttaaacctacatatctttatgcccaatcatttgatcatcaagaggtcaatggaaagagtgtttcctattttttacattagtgacgggcgagggactcattttacagaggttggacacttcactgtgtatgatgtgccgtgtgcttaacaagagatggcgtgcgggctgctgtgacggttctcccttgattccctcgtgaagtgcagcagcgctcttcagtttttctcacctttccccaggtgaaagcaggtgagaatggagccttgagtctgaacccagagcggggctttgtgttgtggctgggtgtgttcactgccggagcttggccgtgtgaacccggagccgggctctgtgtcgtggctgggtgtgttcactgctggttctttgtattcctgcggttgcactgagctcctggagccagacgtttgctggtgatgggcggtcagggtcacccttgagctgcgcacactaaatgacgggagggcatcccgcgtcagtcgccagtgtcgaggcgtcagcagccctccctgcagggaggtggccggtctctttgactgccgtgatcggggcctggcagtttgttagtgcggcctttgtgacacgttgtcacttaggcagacaccatattatttacaccataaggcttaatttgtatggttagttgcatcgcctgcagcaggggtgagcagaacatcgctcactccagagccctctgtaaggcgctgcgacaaggcgagccgccgggccggcagcagaggcttgtgttgctggagcgtgtggaacaacctgggcggcgccacacggctcaggcctctgctttaatgtggcttcattttccactaacttcctactgtgtttctggaaatagatcttcaaggaaaagctttacacaatggtcatctgtaactgacagaacctcttgaaaaataaacctttccgaaacatatctgtgagggagagtggtgccctgcctcccactgcgtgtgtgttctctgtgactgtgtggcattgaatgggcctctagtctccagaaatgagtgactttgtgatgagccctgttgctgcttccactctggggcggggacgctgtagaaggagcacaaagtttcaggctgtgccattaagcaggggaaccccaggagcaacatccgaggcagagggttgtgtcatgcttggcggggctggccctccaggaggggacatgcaggtagacccacatccctgggcttagaggcctgctgggggtgtagagttgagttccttccctctacatgcacagatgccggcgctctacttcccatagcttcccggttcttcgtgccttgtcttcctggcacttaatcgttgactgttcccaggggcagctgaaaggggctggctcattacagagtcagaggaaatcaaggcatgtcccctttccaagttcccaaatttgccatcgtgagcatcatcaaatacattatttgccaagccaggatgttttaattgctttttaaaaaacataaattctgtgaaacagagggaatagtctaatgattcccttttcccatgtatccaggcagtcagtttcaacaattaccaaccgaagtagttgtcggaggggccagtctggctcagctcctctaatggttgtcggagtggccagtccggctcagctctgctaatcgttgtcggagtggccagtctggctcagctctgctctgcct

SEQ ID NO: 291 - DNA, 74 bp, Homo sapiens
gccccccagcccctggtaatgttgatgtgaatctttgacatcatgttactgagtctaaatttatctgtatgtaa

SEQ ID NO: 292 - DNA, 399 bp, Homo sapiens
aaattgcaatactcaaaattatattacatggatgtgaattctccaaaacaacaaaaaaaactttggggatggggtgtgcaaaggaagccttgccctccagatagtctcatcttttggccatttgtcacttaggaaattctctggagatggaactgtgcatggtgctccggtcatacaaagatagctaaaattcaggaatctggttaagctactttgagaaaaggtcttgcaaaagagaaaggattaatcaggaaccccaaataatgaatggtaggccatgaaatgaagggttctgccacagctgtcatcaatgtgacagcctgcggtggatgagcagatcatatcaccactgtagccttccacttacatcaaagttgttgagctgaattcaacatatgc

SEQ ID NO: 293 - DNA, 68 bp, Homo sapiens
aatatatgtatccaaatgactgcacccatttaagcacactgtattgaatttatatttataggctaagt

SEQ ID NO: 294 - DNA, 73 bp, Homo sapiens
tcagtgtttgcatttgaaccactcctcagaaaagtaaaccatcctttgctgtatttgaaaagattctctccag

SEQ ID NO: 295 - DNA, 85 bp, Homo sapiens
tttcatgttaatgggtgttattgatgaaagagtgcttgatcaaataaatctggggaatgctacgttttttgtttgtttgtctgtt

SEQ ID NO: 296 - DNA, 634 bp, Homo sapiens
aacccagaatatttctctgattatttaaaaactcagaggtagggcatgaaaaaaatgttccctagtgtgaaacacagggtgttcacaacattgtgcaatgagattcttctaacaggtatagcacttataagacttatttgaccatgaaacctttttttctagacagtattagtaaggataacacgttctaagctgtattaattttcagagattttgtttttctttttgaccccataaatgatataagtagatactgtgtataataatttacactatatccctattagcatattcagaatattttatggtagaaaaaaaatgagtagaaaagcataatatttcctcttgtcatttttaaagtgtcagcctcttggagaaaagtgacacaccttgttcagaatgaaacatctgcattaaacttgggaattctaaaataatacaaataaattttaataagttatccagatagcctacattagtaaggctttccattcatgtttgtttttgttgtcttggggacttctaaacttctaggtggaactttaagagtgacatgcccataatatcacatttaatctgtgggtgtgactgggagacaatgtattactcacccatttacaacccattagtttcc

SEQ ID NO: 297 - DNA, 645 bp, Homo sapiens
caatgttttgatataaaaaactgaaaaggatatttattgcatttctatctttaagtatatttgtgttatcacaggaaaaacatctcatagttaacaaactaatgctttaaagccaaaatatatgaatatttctgtctagtgcacttttagttaaaattaagaactaagattcaaggcaaagaaatgctgtaatactcttgattcagtattcatgttagtgaaactaagtacagtagtacactaataagggaggaagaatagtgatgtgttaaggacaaagtgttttatcatccggccatacaccaatttacagaccatctcaagtatgctactcttaaatacttttttttccagcaaccaaagtttcaatatattcttttctacaccttacaaaaattatcaaattttagagcagatttttattcttagaaatgctttttattctctaattcacaaatatttattaattaaaaagttgtgttcttctgagattcctcaccaatccatggggtcagttagatatttggggagttgttcagctcttacaaatacccacatttgacactaatgcactgcaacagaataacctgagtaagcttgattctctgaaatagtcagaggaacagaaaaaacaactattaggta

SEQ ID NO: 298 - DNA, 1097 bp, Homo sapiens
tagagttttctctcctctctggttatagagtcaattgtgcactgcactgcatttataatgaggaaataaacagcatagtcttttagtacgggaggtaaacaagagttaacttgtataaatgtaatttaaaatgtgtattctacttaatacatgagaactattaaaatacatgtgcatcaaaaacaaaagaaaaaatagaaataataaatgtctgatccttcagcagaatatttcccaaagagctctattatgtagcaaacttctatgccataagttttaaatgattccatttttcaaatattcatttctgtgtatatttaaacatcatagagtgtctactgaatagagttaagttttaataattgcaattcatcttttttaaaaataatttactctccatttggcttctaaaattttattgcagtatttagaagatttagttagtttctaatagctgaaaaccttcagacttcaatgtcacagtttgacccaaatgcacatggttcctgccctcttcagtttgtgtcctgctgcttccaaatgacaaatgtgggcactttgtgtaaaggcattgattacactgttagatagattctagacatgcttattaaaaaggcatcttttataggtgaatatgccttgcaggatcttgtatcctaggtgaggttattttcatagttacatatttaatgataataataacttgcatctatgccactttcatattctcttggcaccaagtttgccttccaaagcaaactttgactaaagatcttcagggctcatccttagttgcataggcaaagaagttctcatacatacaaccatcacacatttgcaaaaccaccatttattagggtctcttagaatgaattctgtacacatctatgctaaagatggaaaagacgtttcacttcttatgcatcagtagatgggtagtggggccctcagaggaagcagtggggttgttgatcagcaatacctacaatgtgtttaggaagaaggggaggggcagatgatgtattgctccctatccccatttgtcatccctgagttaaaactttctctcccatagccatttccaccccatctcccac

SEQ ID NO: 299 - DNA, 372 bp, Homo sapiens
tgcacctaaagaatgcagattttcttactgactttacatcctgatagagcaatagatgataaagctcgtgttcttatggagcctaaaaaagtctcatagtatatatactactgcctgttagtgctgaaaccatgaataagcatgtgtgagctgtttagtgataaaaagagagcagagatttgggctattagaggtgatcctggcagtgacatctgttgacagaactgggaagttagattacaccaataaaaactgacagcataaggaaaggggaccttcaggaagttactttgcctgatcttccactcatcacactagaccacctccctgtagctgggtagttaggcaaccactctcttgtcctccttcctt

SEQ ID NO: 300 - DNA, 489 bp, Homo sapiens
tgttctgtgttttttcatgatattgacacaactgttcacttcatcactatgtacaggctcaacctaagcaggaaagttgatttccgcatgtgtttgggaacagaataagccaaggcttcacaaggaaatatttaaacatttaaacgtcatagaaattattaccaatccccttggcagttgctgcaatggtaagttaaccccacatgaaatagaaaattaaaataagtagctataagattaaatcagaaatactgtgaaacattttctgcttcctgtttctggtacccgcttcctgagggcacagggatgggcggtaggtggctagactgaatataccattattattcagggaagtttcacctttattcctttattgaaatggggtggcttttgttctttcgtgttttaaggaatggggtgaggagtttaggaatgggacagtataactcagtggtcagtaacatacacactctgccatagcacttatga

SEQ ID NO: 301 - DNA, 86 bp, Homo sapiens
cggagaaattcactaaaagccttttcacattgcctggtacgtggtgagtgcttaatcatgttagctactgaagttggtaaacagtg

SEQ ID NO: 302 - DNA, 190 bp, Homo sapiens
gtaaagctctgcttggcttagctctgcaaatcattttggacaggtgtctagagtcctggttgtctacattcccgggtttgctgattcagggctcaatacatgactgctattctaaggcagaatggtggggccaccactgtcatagagcactttcttaaggaaagggctgtatgaaaaggaagttccccat

SEQ ID NO: 303 - DNA, 1048 bp, Homo sapiens
aaatttaattaaaaaaaaggaagctcccaagagtgacccttgaaatgaattctaggaaagcttttatcattatcatggatggaaaggaaaatgagatgttagcatctgccccaagcttaaaatgtcaccacaattaacacggtagctcgttgacactggctctgcaaaggaaattattcccccaagcctctaaaagcaaacaagcaccccctcaccctgcaaccattacacagaaatctaggaattacctggacagaactgaacactttctgataaatatggttttcataaagctacagaaatctcaggtatttctctccaaaagtgaatgtgcttgttcaaatttgtaaaaggtagacttgatcctctaacccttttgtacaaatctcatctcataaaaacaggaagaaagtcaaatgcaaaaatatgttttgtcaaattccaaagagagtaacctcaccctgaaaaaaatgccaagggaaaatgtttaagatacataagtaaaatactcatggaagaactgactgctatcgaaatttaagttgaacacagttcaattcgtttcagagtaaatcacattttaggcaatgtaccgccttcgtattttttcaaatccctgcagcagtgatgggatatgatcagagactaagacatatcattaagatagcaagataattttgagaagtgtatgctgttctttcagccaccaaaatttcacaaatttatgagttcttaacaactgacacttttacattaattcaggattgagagaaaaaagtctacatttgatttctcagccctcaaattagatgtcttcaacaggcacttctatttggttagattaaacaagttaatctttctacagatctgctttaggcaaattttatggctcttttaacatacgatcaataattttctagaaaaacatagtcaaaataatttggcatcagaaaaacttatagtaacaaacatgctattcatatgaaaaatcaaatctcctttcttgttacatcactgtagcttttaaaaagaaaaaaatgcataagtt

SEQ ID NO: 304 - DNA, 598 bp, Homo sapiens
acagcccatctaattcatttatttcgaaggagctgactttcctcagactttcataccttcagatcttcttaaactgcagcagagttttaactcttgagtttcctctgtgatctgaacccattaacctggaaggcaaggagcacaccaggcctaaaactaattcttggcttgagtttcaacagatggtgaagttagtattatcgtcagaaaacaaccctacttcatctctcctccccaccagttatgagatttggacttctgttgcaggagttcactatgcaacacggttaagtgacagattctcttgagtcatgagttcctcttttcaaacttgaacagtttcccatatttcaaagctcctcactcagacatattcagttcctagtttcctcaagatgcactctctgaattcccagaaacgttctgtgctccagttcttggcctgaaggatctcaaccgtcttctctgaggcatcagacagagtagatatgaggcctggagccagaaagtgcttactgcttcctgttcttaggttggaaaagaatctgttcttgttaacaagagaggtattttgaagagaaacaaacaatacccttct

SEQ ID NO: 305 - DNA, 1343 bp, Homo sapiens
gaatggaaagatgaaaggcagaaatttctgtggttggccagttcaagcacaatgagtataccaggcaaatgccccctgctcactagagaatgaaaacatcacgcttctctgtgttctaggtcaactggagagaactatgtctgaaaatgcatgaggaacatgtttattggtggggtgagggcagtgacatgtgcccatgcctcttcaggttaggtgtgtatctacatgtatataggtattataggcaaagagattgttgtgagactagctgcaaaatggaacttgtatggaacacaaagatccaaggggttaatttcttgaatgttcatgccactcttgctgtgccaaggattgtgctagagcactagcagtcttttcaggacagggtcccagatgtgcccaagatgagctgatgccagggaaatggactccatagctatagtctctgacagggcaacctgagtcctttgtcaaagagcagcttccttcctgaacacatctttgcttacaaagacacttgttctttttctttccactttaactgaaaaagtccccctctcaactctccctcccaccccacccccttaatgccaccatatccattccttgtttccaggcaaattcgcattcatctctccaaataaatgtgcctctgtttttcttacagacatctcaaaataaaaaattagcaacatattctaggagaaaaccagatgaattctgtgtctggggtaaaattcactaattttcctctgtaatagctacactgtaattacatagtcaatactaaatgtgcccctaagcaatcatcttactgaatttatgcagtataagcaggcaacagaaatcatctcactgaaagtaattctttccttctcatcaaaaggaagggaggggttgtctaagttatctaactaattatcttaattccttctttgtggttatgtccacaaccagtctttggatttctggggttaggcccaggcaaaaataagttccatcaaagttatatatattcaatttatcacaatgccctctaaacacgttatggtcaaaaactaattatacaatcataagaagtgaattttgaaaatataactaataataggctaatatttttaatgttttaatacgtactagacatcttatttgtattacgttacttaacctttaaaaggacccatttaatgaaaactcccttttactaagccttaggcaacttacttactatggccttgaacccagattatctctagcccaaaggcaatgatgttgagggagaaaaaagaggactaagagttatgtggctcaaggtctagtttgggttaagatacatagaggtt

SEQ ID NO: 306 - DNA, 378 bp, Homo sapiens
ccagcaggaaattcaggcatggtcacaccatcctaaccaagtagtagttagcatgcctcaaccaacagccattatcactgcaggacccttgacaccacaaaccccagacatactgctgctgtgaatgacttctgaaattgctcttacgtctttgcgccactccttcaagattaaatttctaaacagtggtatctgataagtcaagcaaaggtcatatgctcaagccgtggcagaggatggaaggagaaaatccagcccatttagcttctctcatggcaggctaggtcttgcctccaaataatattatgcaatggaggattcttactaatagaaaaggagttcagctgctgggcagcctttcaaaactgacaacacctg

SEQ ID NO: 307 - DNA, 107 bp, Homo sapiens
ctgcacctaaccacaagaagtcagtttgggaaataatacgcagctatgtgttccagaggaaatggaaacaagatttggtgcaacacagcagactctgtcacacctac

SEQ ID NO: 308 - DNA, 199 bp, Homo sapiens
ctaacatgagctacaggtgatgctgctgctattgattaagccagggagtttctgtgcatcctccacattgctaaaacatacagcaatttgggtatgagaagaaaccgaaatataatcagaaggtccttcctcctgtaggggagactctttaactagtaaggctttatttctccacttgtatcttcaaaaatgggccact

SEQ ID NO: 309 - DNA, 2754 bp, Homo sapiens
ggccactgcaggtaaataatctcctttctttgcccattggtccaatccacatgggcgtgtggtgaaactggagggaaaaaaagggagcgagcagaataaaagagcagaaagctattactttgaggagtgtaattgtcagagcaggctgtcagagcagcctgaagcaatcactcagtaggggccagcctccacagcagtaatttatcaccacatgaagatgttggggagttaatcacagcactgacatgtgtcagctccaggcattgggctcagcataaacttcatgcttagaaaatgaaaataattaagagggcacacatttgaaatgtaccactaaaaagggaaggcagtcatcttagggtcaggtgaatgccatgtttgtaatccactaaaccaactggaagagcctgtggagggcaaatgtgtccaagggtactttgctatttgtacctgatagatgcctttcacactgttttgagtctctgcatggcctgtcatgaaagagaaaagcaaacacaatttgcacaggctttgctacatgaatattagtgcttcaggaatgctctaagatcctgccagctgcggctcaggaaggggtccaggccagatctgactcatcctgctgccttcctcctggaaatgatcccctttctcaccccactcctgctggctgagcccaggtcctgtctgtcccatatttcctttgatccaaggaaaactaaaagtggttactagctcccaagcggcctttgtttataaatgggttcccaccttaatatgtttactcaaaaaactcgtcaaataattagctataacagagcaatcaaactgatcaaacagttcttggagtagttcaaaccttcagagagttatttaatgacagttttaaataactgaactggggtcttccagcatagagaagtagggattgtggcagaaactgcgagggagaatttttaaagtgcttagaataaaaatcttttcattgaaaaaaaatgacaagaattgcccacataattatggcaatttttcctttccttttgcaatgcaaattcctggcagagtgtaagagaaactgagctccactgtcccagtttttcaaactaagaaaataaaataatttgctacctaaactttcaacttctacttttgaaagctaaatttaagttttaagaatcgtacaacaaaagagactacagataaacctcattacaattttttagtattgagcattaggttatttattttccttcttcctaaagctactgtagaaagaaaattcaaaggactagtaagaaaaatagctcaattgataacaagtctggtttgtcaatgacatgctaatacctgtaacagttactaattatctcagcagtgtgtctcagtttttatatttaatatattcttcatcattcttaaattaataaatagcaaccaattgttttctcttttacaagcttcatatggaaagaaaattgaaaaaaaaaatttgtattagcagaaagtgaatataagggacttcccaacctcccctccatatatttactgacaagcaactgacatgagtgatagcaaagcaatgtggttagtgaggaatggcgcagagtgtgcagtttccttttttctaatgttgatttgttttctgtgctgacacaatcctagaggttactgttcaaaggaagcatcgacaacagaagtgattagagtactgattaaaagaagatttttaagaaaatgaccaatcaccatcaatcttaatattggctaacaaatgtgtatttttctttctcatattattaagtaaatagtataaacagaataattctttattagtatatccatatagtgccttttgcaagtaaatatgattctggatattttatgacctgtaattacttgaaatcggaaagcccttttagtttctcttattacccatgtgttgctgagactaactgaagaaccagttaggaggtttgttcgttcacgaaataacatttaagaaatgggtacctgcttatcacataaaagaatccagttatttacttaccctgtgaggagacataatatgttagaatgcttgtacactgcagatgggaagaggtttttccaggaatttaaattgtgcaataaggccacacaatcttacttaaaaaaaatggtgaaggggttttaattacaccatgaagttttacaattttttaggtttttagttctggttttagaaaacagagtagaaggattacagagaaaaacttcaccattagacaagaagtcaaaatgattctaagggccgcgcaaacaggcttttccaagaattaatcatgaggtggtgcttggagaattcctttactccagtgactttgaaacccccttctcactctccactagtctttcaaaggattcatggtgaattgggtctaacgagtataacacggccggccgaaggcatgaagctcacgctaccctttcagggcggagaagttcccaggaggaagaatggagaaaaagatcgcagttaggcagtcctcccaacctcaccaaggctccacctctctccaaagccgcaaggctctgccacctgcgccgggagaggctgcaatcactgtctcctcctctttctttctcttttttttttttcttttttgcctggggtgcccgaccaagcgcagcccgcagtctgggcactgccaactgactccaactccttttatggtgagaggatggattcttcgttatttccccgcccaatctggt

SEQ ID NO: 310 - DNA, 336 bp, Homo sapiens
acgtccgctgggcgcacccaagtctaaccccggggcgcacgcgctagcgcagacaccgtatttcttctcctttctcggccaaccctaggtagaatcctaaaacaactgccctctcttccacgatctagatgttgcggcccgcggacaggaggttcaagaaatagtacactccgagcggcaggcagcgaggcggaaacggtcgccggtttcagtggtggccccactggaagccgagttcaggagcggctaagcggtcgccggggaaagcaccggggcttcccagggtcccctccgagttcccactccgcacctccgagggcgtgaaaaccacgggag

SEQ ID NO: 311 - DNA, 2552 bp, Homo sapiens
agggaggacgcgctccgcccccttccaatccggccaatgggcgcccgggcagcgcgcggtttgcctccgcctccgccagggaaacttggaggaggagaaaagtttgtacagagggtggaaaggcgagagcggagctccaagcccggcagcccgagaggaagatgaacagccccaggccagagcctctggcagagtggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgcaaaacctgaaatgtcagggatggtgatctgttcgttgtaaaccatttttaaggaaagtggggtttttggtgttttgatgtatgcaaggtttcttgaatttcttcccc

SEQ ID NO: 312 - DNA, 2113 bp, Homo sapiens
tacgcttaaaataatccagccgaacctacacagtcaagctaggctccctgctctttaccatggtgtgccctgggagggcagcttaaagcacacaaattctaattcatatacagggcagggtccagactcagtttctttcattctgtctagaccaggaaagcaaagtttctcagggtgactaattatggacaggctgatatacatagggtatgggatttgaattctcgacaactgtgcgaggtacagtaccattttagagaaaccgaggtttagagatggctgtctttgtttcttcaagccaaagctctacagcttgtaatggaccttaggccgtctgaggccagacccagctcatgtgttattacatcacgtctccctcgtagaacatttctcattttggcgtttgtaaagcgtgggttggagttttggtacacttcatttttagttcatcttttaagaattgcctttggattaacttttaaaatatgataaacagaaaggctcaaaccctacctagttttctactttgcctgtggctaaaatggaatgcaccagaagcagatgggcagaataatgcaatactttatctagagtttctcttgaaagcaactagttatgagttcttccatcttccaaaacactgcattcctggaaattctaaactaccaactcaaaaagagataactgctttttcttatgcttgttgggaacaagagaatataaaatgtaatgggctattattccttccttttccttattgatactgtccagggatctttggtgtaaaaatatatctttgataaaagtgactgtaaatggaaggaacttagagggggctcagagccagaatacagtaggttcttaccaatttgtataaacagaagtaaatataataggccataagagcctttaagccattccaggacccaatataatttacagagttaagtcacacttgagccacataaatatattttactgtctgtaatggcaacctagaataaagtgagattttggaagaaacaacactgctcctgatggggcccctgttcctgggcctctgccttgtgttttacagaacagtaaatgacaaagtgaatggttgttattttcagaacatccacttaaagggacagaggaattagagctagaaggttagcaacatgcacatactttataaatgtgttttggttggaagtaagcatgtaaagctatggatttctgcacagccacggatgaattattttcttccaacatctagagagacatacaaggcttaattcacctcataggctgaagtggtagacctggacctaagattcagggcccttacacaaagccttgaaattatttgaggacctagaggcaagaaattataggagctgtatttgtggtttgcagattaaccacattttaactaacaagaaatactgtccacctgtataatgttagtaacgtgtagtaaattttaagtaatcttgacctgaaaattgaaactagctcaattaagaagtaatcccattagtcaagtatttatatagctttgtgagaaataaggaatcctaaaatagcagtggcatcagtttgtcgcctttagttttggctactaaagtctaatttcagaatcagtttaattataaattagtgataaatgatgggttcattatgccacccacccacccccccccccacaattcagcaattactgaaataatcaaaaacccttccgcaaatacagtcttccttggcttccttttacaactttcttttttcatgttttcatattcatgttgtaaattaagattaaagctcagaactctctgacattgaaagcagttgagcttatcttcagttccaaagaaactaatgaagcatctaattttatcaaatcaagtggttgctaatcccatttaaggaaaatcaaagcgttggaatcattttaaatgctttggaaaggctaacaaagcaaatgtagtttacttggaatttcagaaagcttgatataatacctaaggaaaacaagcagccactgaaaagcagccaaggttttgcctcctggacaccagggaagaaagagctacagctcttagaggggggttggtattgagtttag

SEQ ID NO: 313 - DNA, 1951 bp, Homo sapiens
gctatccaaaatatacatatttcataaatagagttaagattggagtggaaatttgagaaaggttgggaaattagttgtggatataaggaactgtgctgaacctgcagcattctttgaactgggtcataattaatgatcagagaaggtgtaagtatgatctacaaggaacatcacatgacaagatttagtgggtaggtggttcttgtcattttgtccattcttctatttataaccagtctcatagtttttttaaatataggagaattttggaagtgagaacttctaaaattttgtgagaacaagaagtgagagtctacatttaagataaacgaaaaggattgaattctttagaaatatgcaagcaagacagcctcctaaggtcctggttttaaatgctgtagcttgatgaattactagtgcctaattttgcagttactaatgaatattaagatgattattataatcaaatattttgccttagggctaaacagttactatagggtttcgaaggtcattttcccccatacacaagcaacccaagactgtatttattgcttacttgtttcttttattttttaactctgaagtaacaaatactcatctcagctaggggcagaacagctaatttgattaatcttctgccttggtgaggtaaaacttaggtccttaggaaaatacttcctgtgactgtttatttggttccttactataaactagttgtctctataaagctttcaccagcatttgatcagcaaaagtttataaggacagataaaaactttgtaaatagatatgcttttgtttactgtaggcaaactggaagtggagtcataaaacaactgatgggatgtcagatgagtgtgaagcacatctatacatacaagagaaatgccacaaatttgggtatgactatgacagaatctaaaagactggatttgttcaaataaatttggctaagtttaaaaaattgcaatgcctagaaggaagttttaaatcataacatgcaattgcagacccagtagtagtaacctgaagactattgagtaacataaaagtaagttatttccacatctggcatttcatttgaatcttgaaaagctctaaggagaaagtagggctgaccagtattttcactctctctacacctcagtttcccaagctgcaaatgaagaatttatatcattctgcaacttacagggtagctataggtgagtcctcgtctaatgctcatttcaccatgctttcttgacctgtcaatttgtttgtattgaatatctcctaacaagattttttttctcagccctgacgtgattcttgtagtctcctatcagaatattcaatgtgagagctttaaaaacaaacaaataaaaaaaaacagaaactttcagtgtagaggttgacctataaagcctgtagagatttaacttgccttctacaaatggccagaagaagaaccaagctctcctacacaccacccagtcaataattatttccactattctttacttgaaaaaaagaaagtgataagaacttctagtaacagctgtgtcaattttggactcttaacaaggcagtgggataactgagcccatacagataattccttttatgtgcttggaacagaacaagtagcacacacattcaaatccagctacagatcttgtcacttattggaaagcgttactgttttgacagtccattactaaatctaatcaagagttcaacattctttcttcaacattccctgcaaacaaattattaagtaggaagtacatgtttttgataccatattattaactatatcccaaagctacctctaagctacagttttcaaattattgataccttccacactgggcaagcttccacatatgggttgaaagaaaaagtaatgagagccaacatatctgttatacgataggcactgtactaagcactttaataatttgta

SEQ ID NO: 314 - DNA, 125 bp, Homo sapiens
cttacagctttcttgtcaccacatcttcttctgaacttattgcatttcctcaaagttatgttccactgctcctgagccctaatctctaatcatcctaaaaaaaagtgtgaataacataatttaaa

SEQ ID NO: 315 - DNA, 125 bp, Homo sapiens
taatttagaatactgtaatatgccaatattaacaacaaaccacatgtacacagcaggagctactagaaaaagacttaaaattggaagaaaggagatacgttgtttgtattcagtgagtttttttg

SEQ ID NO: 316 - DNA, 1612 bp, Homo sapiens
atattccctcctgactcggaggttcagttttatcagcaacacactcttccaacactgaaaactgcctgaacttgtttaattatgtaaaatatagggcctgttggacaagaattccgaaaagtgctttcaccccctcacgagacattgaagcactactccggatgtccccatctcaactggggttgtccctgccctcttggaaacagcaaatcaagtagcctacttaaagtgaagcagaggttgctctatgttttcaaacattgcaagatgcgtggagtttttgtttgttttgtcttttttctttccctacttgaagtaagtctcaattgaaatacgctgcaaagtaaaactcatattgattcttttcaatctaaccaacttttgaggatgtttttacctgaatttggacttttgctttttaaactcatacttttactaccctgtgaactcccctttattgaaaagacattgaatgaccaggttcagtggcttgtactaattgtaaacttttcctcccccatggaaaactttaaaatagagcatacttttaatatagcctcctttcattccctcctatactagtcgaaatccattgctgctgtggatgagatgaggcacagaaatgattctttccttgcctctcatcacctttgattatgaaaacctattattaattgttttacaacattccaacctttctaaaaggccacagaaattttaaaatgctaactcctaatgtacttctttgaatggctataaattccattttaactattcaaaaattttcttcctttcagtagtagccatgtttcctttgaggttgtggtaggagaagcaaccagcaataaaacattttcagtgtcaaaaatctcagaaacgtcaggttcagacttaaccaaaattctgttctgcgagtctcggagatggctttacacagtgcttgttagggaggtagtatcagaaactctcaagtggagcaacactgccacctggaggcttgaaggctcaagttcgcataaacccggccgtaggtcttttccagagaccacacacaggacttgatactaacagatttaacgccatcatttcttctacccttaggaacgtagtatgtgatgtgaataaaatatagacctcatgctttttaccaacaattccattgtcaggaaataataattaaacagaaagccagactggtagaacagaaaaggcaacatggaggtccagaccagactctgccaccaacagggtgggggacatcctaagttcctcaaaacctctgggtctcagtaacaaatacctcatctgagaaaaggcctgtagagttgagggaactgctgagtttccaggcatagctgaagacctcaaagcttatggaaggaagaaaccaagatgctttattttactttctgtaaagatttttttttaaatcaagtatgctttgccttgatactatcatttatcccagcgtagtttctaaaagtatttcaagaggcgatattacacactgctgttcattctagttcattcttgatttagctgtcttccatataggaagatattaatttcatcttggttagaggcatgtcactattttattctctgagattta

SEQ ID NO: 317 - DNA, 492 bp, Homo sapiens
aaaacaagtgaataacaacaaaacaataacaaaggaaatgaacaaaaatcttttgagagaggatcagagacctatagctaattaagatctaaattccagttaaggaagaaaaagaaatgcagttctaccttactgatccagtatcatccaggagtaagtttaatataagcttgattttgcagattaatgaaatgtatttcttcgaatattttaaagattcaaagaatctttaaaggaagaaaaaaataattcttccttcttttacccaaattttacccaaattgttgaaaatctttctataatatcctgacccaaatattgttacatctagtaagtgccaaaggaacacatgcaaatggtcaatgaatcgccttttccgttgtgaactgactcagcctcaactaaactgtccctgttccaggtgattcatacaccatgagtcattcattgttacgctgtatatagtaaggcagcaacatcctcaagtcttgt

SEQ ID NO: 318 - DNA, 78 bp, Homo sapiens
caacctcttctccctaacctaaaataattactaaaggcaagaaataattactaaataattacttaagatatatggcaa

SEQ ID NO: 319 - DNA, 90 bp, Homo sapiens
acagatgagatttttatataaatgatcccagtggaattagaagtaatatctaggcaaaaaaaaatcataatactttaagagtaaatttga

SEQ ID NO: 320 - DNA, 74 bp, Homo sapiens
tatatatacatgtacatttaacaaatgcattttcccctaaggattaaaatgatcatgtaagtttacacaaattc

SEQ ID NO: 321 - DNA, 458 bp, Homo sapiens
gttgtgattactataactggggaacagagtcatagagaaaataaaaactattctctggtcattctgggtaacaggagatcctgctgttggtgtaaaacttttcagcatattctttctagactagaataaaagaatcttggccttattctggtgattagatggttaattgacttataaaatgagtttcctttaaattatgtaaaatgacagctggaataagaaatcagtagcttttgggggaaaaaagttacttcattagaattacaaaaacttaaaagcactcacagaaatgaagttaataaagtgcttctcaagaacactttatacatatgtgacctgcactcacattgcatttttgtatactgtctttgctctagggaagataatcataagatagttacaaaaatattaaagctatacgaactcagaacatgtaattgcatttttgcagtgactgg

SEQ ID NO: 322 - DNA, 1679 bp, Homo sapiens
catgactggtttttctgaggcttattatgtagcttcctcttttcctggaacttgttaccagaaatgaaggcagcttcctaatattgataaggtagacatagcatttatatgttttcccaattgattaatgatgaaatctaaatgtgcgatctcacttatgcaggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtatttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataaccca

SEQ ID NO: 323 - DNA, 1387 bp, Homo sapiens
ttggaggttttcacggtgaacacagaaaggggcactccgtccgagctgagcctcagggaccgtgaggcttgctcttggccctgctgctcatacagccctccgtgcctcgcttccctcccacagcaaggaaggatgacgggtgcggggtctgcacggtggcgcggggtggccgcgttgctcaggaggcacttgcaggtcaccactgctgcttacacagccttactctagcaaggccctgggcagccacactgtgacactcggaacgtcacacctggcgttttccaaatgaattgaatgggtaggaatctccacatccctggatacttcgcagagttgcggagggactggccacgcagctccgcagacagccgcctcccacacgcactcaggtacacacaaccctcacctgcagcctaggccttcaacacctgatgctcacggaactttctggagcttccagggagtgacaggagcttcccggggagctctgcatttcctgggaaactctgtttcccagggagctccttcccttctaggccccgcgtctgcagtgacagctgggaggcctggactcagagcggtgacctttcctcacctctccctggcacgtctgcgcctctgcccctatggcatttggaagcccccccgcccccccgcccaccacacacacaccgctgcctctgccgcaggacatgagtggcggctgccagatgacacctgtctgctggccagagcgggcgcctgacctcgctggcctgcactggaggctctgcaggtggggaaggcagcgtgcagtggccatctggcatgtcccagaggctcccggcctgggtggtgacaggttcccctcgcccctcatggcccacgctcaggatgggctggtcctgcatccttgggccccgtgtgaacgtggaaatgcccagcccctgctgccctcccgtccttctacatggggacaggaatgtgactctcccggtggcagtgaccaccgcctgcaggggcctgctggcctcccttttgcacccggctcaggtgcctcctggccgagactccttgaggccactgtgtgacacacaccacacacccctggcaccagaggcccgggaagggccagcccctcctagcggcttctccggccctatgggggagggtgggcacatgcttggcaacccctggagagaaggggaggggccacatccagtccatctatcttcgctttttacatttttatccagcaagcatgtgtttcatcatgttaaaagagcaatccatattctaaaaatcatgagaaagaattgaaggtagcttcctggcaggaagaatgaaatcgtgggtcccaccacaagacaccgtcaccttgctccccatttcctttcccatttaaaca

SEQ ID NO: 324 - DNA, 302 bp, Homo sapiens
acctccctgcctgatggcttctcctgggtgacacctgctgtgcctagggccatctcgtggcccctgctgcctcatgctctggggttcagggtgcattcccatctcctctgtcgcctggtggctcactgtggcctcttccctgcctctaccacaggtgtttttctgggcataaaatctattcctgactccatctggagctcccagtggttcagggcatggagaccaggcacacgtaaagattgcatctctgactgaattgagaataagctgccttcaggactcacgcttgatcaacctcgcca

SEQ ID NO: 325 - DNA, 5806 bp, Homo sapiens
gcaacctcttatttccaaagcttgcagctctgcagctggagggctgtgtgggcactttcttggcaacatgggccctgtggccatgaatggcagcggtcaccttcctggatggggctgacttttctctagcctgagccacagcctgagcctctgactccactcagtgtgacctgcagacaattgtttgcggccccattctaattccctcctagggactctcagccatctttctttttccttgtggcaagagatggccaggactttggaatgggcaatgggtttactgaagatcacgtccgtggaatgctgggctctggcgtggtctgacccttgcagtgagcctcttttctcagctatttcatgactctatccagataggagctaccttaggaaaagagcaacacctacgattcctatccatagaatggctttagtcgggtcccatggaatacaattgattacaccctgagctcagatcaggttctacaaattcatgctgacattcctgcactgtagataaacctgcgtcctgtggcttccctgccctaggtgcagctccagctccttccttaactccactggtattccctttaatctgcaggaggggccagtgattgactttgggtgtacactgtccctccacaccacttccctgtcttccatggttttttgtattcattttcttccacctcccaggcactgacccccagtagtgaccctggggggagaccatgccaggaagcacactggctggggcgaccctgaggcatcccagggagaggcaggagccagaggcagcaggagctgaaaggagatacctgttctctgcaggtctgtgctgtgcaccctctgcacccacgaggcatcctcagaagtggggagggagaaggagggatggaggagtcttttagcatagtgtggcctccatcttccctccccaggacaccggggaccatcctgagggtggcctgagttgagggcccctctgcagaggctggcagtcaggcccacatcccgagagcgggacagggacatttggccaggcagttgaagctggaggttcagacggccgtttatttggggatttatgaccttaagggtccctctggagtggagaagagcagctgcctcctctgctcagcctggacacccctcctgcctgttgggacactctgtgggtgccgcctgtgagtcctgaaatgtgcgatgtcctgtacgtgctgcccagctcgatgtgaggcaacgcgctgtccccatgcctctcgcggggcccatcagtcatccctgagcacagactccgcttgccctgcacttacagccgtcacgtcgctaaatggctctgcctgttaccgcagcgcaaatacatgatcctttcactttgcagattccatgtaattgtgcgtggactgtgtcagcttcggatttaattggtgtgtaggctgcgaggcatgaattacagcatgtgtaatttatttatgcaatacaatttaccattaactgagagaggaaaaataaagagaaaaataatatgttttgtactataattacataataaagtttgaattaggaatatcacttggcccacaaacttcctctggcctgagaaagatcagaaagcaacgtcgtctcttcagttccttcctggattctcaggaggagcaggtctccctctaagtgccacgggacaagcgcgttggtggtaaacggagccgcggggaagagtggggcctttgagaaccagctgcattgacggggacatggccagcccaggtcaactggggagagatggagaaaagtaggggacggataaagagaaagttactttttttcttatataaaatgaatcgtgaaaactgctcactggatagccaggccacttactcataaagaaaaagcaagagaaatgcctgccactgcgcctgggagtccattcccaggtctagggccaccccagagctcccggtcaccctcaagctgaaatgttagacgcggagggctggcttcccatgacattttcaccggagcccctggcatgactcaaaatctgtggttcttcaaaatgatgaacatgggctcccgttgtctcctcacgcgggaaggtccaggagcccacacccaggtgtgactctattctgctgcggtgactccggacgtgaggctgggacgagcctgagggagctgcgtgctcgccagcgcctcccggcccacctctgcggtccgtcctccggagcccaccccggctccaccttggctcccaggccggcacccccgggctgagcacagggccaggggcaggcgggttccagagggagcatttccaagggaggaggaaaaccaaagtgcctgccaggcagggggcaaggacagaggggaaacgcccccgctcccagggccgggtgagagacggtggggaccagctcagggacccccacccagaggggccgccacttccacggggaatgctggtcggagtgggctccggaccttcccgcgtgaggagacaacaggagcccaggcttgacgtggcctctccgcctcaaacccgggccgctggctccccgcacaggctggggcggcgtggggcgggcggaagagcccgatccctctgcggccggcctggttgattcgggcccagcggaccctgcctggccctggccctggaggccgctgcggcccccacccagctcctcagcagccacatggcgccggccctcacaccccggggcggcgcacagggcctgggcctgacgacgtccttagggtccctgagcagccgggtccccacggccctcggcgacccggggtccccgggatggagcgaggctctgggccttcagcagacgccggggccccagacgcccctgaaccgagctccagagacatccgagcccaggctcctagagaaccgccccccgccgggtgcgtccgagtcagggctcccccgaaggcggggacgtcgggcgagaagcaactgcaaggactcgcgtgaagaagccaccgggaatcatggcggccgcgctcagagggacggctttgcacgcaagctgtatttttcttcaactcctctgtgtttttcagatcttctgtagaagtgtctgtagtgaccatcagaaaaacaatctgaaagaaagacaggaattgccaccgaccccagggctgcatttattgctggacatttgtcacggtctgagccgtgtggaccggccccgctcagccagagccaggagggctacgaggggaggcggggcagggtttggggacgatttctctccgaccgaaggagtaatggggccatcacgtaggcaaggtcaaaggacgatgtggcggttgcagggtgacccgaggtcacgtaggcaaggtcaaaggacgatgtggcggttgcagggtgacccgaggtcacgtagggaaggtcaaaggacgatgtggtggttgcagggtgacccgaggtcacgtaggcaaggtcaaaggacgatgtgggggttgcagggtgacccgaggtcacgtagggaaggtcaaaggacgatgtggcggttgcagggtgacccgaggtcacgtaggcaaggtcaaaggacgatgtggcggttgcagggtgacccgaggtcacgtagggaaggtcaaaggacgatgtggcggttgcagggtgacccgaggtcacgtagggaaggtcaaaggacgatgtgggggttgcagggtgacccgaggtcacgtaggcaaggtcaaaggacgatgtggcggttgcagggtgacccgaggtcacgtagggaaggtcaaaggacgatgtgggggttgcagggtgacccgaggtcacgtagggaaggtcaaaggacgatgtgggggttgcagggtgacccgaggtcatgtaggcaaggtcaaaggacgatgtggcggttgcagggtgacccgaggtcatgtaggcaaggtcaaaggacgatgtgagggttgcagggtgacccgaggccagcagtcctttgcagagtggatgagctttcagtgaggggtgaagtgtggaatgggactcgctgacgaaagcccactcctccctgggccaggaggggcgcggggcccagggccggtgtggctggacgggggcctcccaggtggacgggcaggggggctctgagagcagctgccgggatgggaggcggatgcgtctgcctgctctgtccaggcctggggcctgttcccaccaggacgtgccggaaagaggctcttgctctgtgggaaaatcattctgctcctctttcctgtacagccctgaggcagagcccgcactgcggtttccttagttgggagctgtggttgtgaggagcccccagtctctatcgttcagggatccccttgacctcagtaaaagccccccttaagtccaccaaccttctgagagcctccacttggctctggtggggcagtgccctggaagagaggtttggggctgctgatcctggccaagggtcttccagaatgacgctactcaatgtccaggaatcataggagcccagtgtcttggcctcaccaggctctgtcaccccctcaaccctgtggccctgcagttcttgaagctcaggtcccagtccttggtgacgactgaacaaccctggcctctgcttacttcttcaggaagctggagccttaccctgttagcaacgtctttccagcatccctgggagagaagcagcttgccagccctctgggcttggttttaaacctgcaactggagcatggcccagaggtatgtgtgtgcctgggccctgcccagtgagcgggagcctggctctgagcatcctgcctgaacatccccagcccctggcggggcgacgccactgagcaagacaccctgggaggtgaattcggcaatgggatggcacaaaggcccagctttcccatctaatgagacaacttccaccgaactcacaacaccgtaaaccttctagagaccaaggcaacgtgcacccagaaaatgtttggatcattctctgcctagactaatttagagggaagattctcagcgaatccagcccccaacccttgattgtctccggcaaggatgttaggtccccctgtgcttcaacatgtttggaacaagaaccaattcgtttgttcctaacgtgacacctggaggaggcagagtcgctgtggatgccacgccacctcgcagccgtgacagctaatgacgcctgcagtccccaccatggtccctgcctcatcctctgtgccgttgtcttgtgtgttccatttatatgaatggcaacaaaagtagaaaccaggaaagcaaaatggcttcagtgaggctgttttgttttgttttgtttttcttcttcaacctgggaaattcaggtcaataaaagtgtaacagaaagatgagaagaaagaacatcccgaagtagtgtgtttaaatcgctccagcgccaagaccacaaatcctgggaagcacaggtgtccttttcacggcctcgcaaggaaagcaggtgccttctccacagagactcttggtgggctcctcgatttggggtcatctgctcctgcagcctgggctcgcgggggtgagaacacaacagggtgagccattttgctgcggtgccccaggcatcttctgggtgtggaggcaactccacgtgagaggtaccggtgcgtcccagtcccagacttgtgccacttttctgagccctctgggccggcctcatgccttccgggcctgctgagctctgtgccctacctgccactcctggagggcaggctgccactgtgctcgcggggcctcgctgcagggtgggctcaccaggggcagcttctgcggtgtgtgtccatc

SEQ ID NO: 326 - DNA, 497 bp, Homo sapiens
cacggccatccttcctcagatccactccagaggctctgctggctggtccttcttcgccacaaatgtttggggtttctgggcctgcagcctgccctgccgtgagcctgcatcgagcctcatcctgtgtgtgagggggtcactgggctaggagctcgtggcttcttgagggggtgcagcaggggtgacatcaaacccagcccgtgctgttcccactgtcctccatccgcatggtgccgtgatgctcgtcctgaggtcatggggtgaagcgtctgctgccttgggtttagggcggtcgccctctgcaagaacatcacaggaaatgtgcaaacaggatctcagaatggaaccatcgacatgtttgagggagtggcctgtttttatggaatcccaggacaaaccttgttgcaaaatgaaaaatctttccacaaaatgaccaagcgctccctaataggcgccatctatgagcctcacatttggggtggttggtttgctgatgt

SEQ ID NO: 327 - DNA, 348 bp, Homo sapiens
acttaaagtgacttttcattcttgatctggcagaaaggcttgggcagcagccaggggaatccacgcctccctccatggggcctcttgaaatccacgcagcagtgccaggctccatctggggcatggcacagcagtgaatgccaggacttttagcagcttccgctggagttggggatggagggagatgaaggcccctgtagtcagcatgtgacttgtcatgggacaggctgcgtccaggggtacgggtcttgcagaggggaccatggctgagttgtactgaggcccccgggagggggaccgctgaagcctgccgtggtccccttagccctgcggtaggacaagctcatc

SEQ ID NO: 328 - DNA, 245 bp, Homo sapiens
gggctgttcccccagctcctcccacaggctcagccccaagtccagggtgctcactcacattctaccatcagctgtgacacccgggcccaaaagtggcttcttctgcatggatgtcccctgcagggactggccgacacgatggtgctgcttatgagcataatttgctctctcttctacagaaataccatgttgctcaagctctcccagcaaattgctcctaagcacagaagaaagtgggctcagaa

SEQ ID NO: 329 - DNA, 647 bp, Homo sapiens
gtcaggaggtcatggcctaagtggtcaccatccatcccaaatctgctgtgtttaggagaccatgggctggaagacccaggagtggatgcttttgccccaacgatggctgtcacccagaatcccatggggccgccaccctccagcagctgagagggacctggtggagaatcataaccttccctaccatccagcacctcagaggtggctctgctggtgggagaatcacaactttccacctgtaagtagttggatgctccacgtgacacactgggcagagtcgccagtgtttcccagacatcaatatgctttctaaatagaggccacaacattgtggccaatttaagcacagctctgagcccagccagctcagagccccatgaagttccatgaagtggaaacgtcaggtatcagtaagttacacctggtttggaaattcagctgagcccaggctttcaacaggcaggcacacctgtcttccaggctcagggagcggcctcctgatatccatttagcacgtggtaaaggctcttccagggcagcttacaagctttgaggccggcgtttcccaccatggtgcctgtcttcacagtcctccgggatggcgccgtgactgcattcctgtctggcgggaagaggcggttctgacc

SEQ ID NO: 330 - DNA, 48 bp, Homo sapiens
ggcttaggtattctgttacaagcaaaagagaacaaacgatcacagctc

SEQ ID NO: 331 - DNA, 302 bp, Homo sapiens
gacggcggcctcaggtcacggctgtggtggagtctaacagtgggggctctcttctcatccatgctgtggggagggggtcctctggactctggaggagaagtgacgcggtgggtgagaaggtcatgcgtaagaaacccagccacggcgacagctccctctcctgagatgtttgtctttcctggtagcatttggcttcatcttacgatggcaaccatcaagtctgtgtttcagaactgttagagccactgatggtcactcagaccaacacaagccagcggacgcagtcagggcaccggtggccg

SEQ ID NO: 332 - DNA, 234 bp, Homo sapiens
tgaccctgggacttaaggctggtgctaggtgataggaggtgacagtggactcgagtctttcaggccaggagagggtggtcggggcaagagcaggaagcggtgccctgagtgactggggaattcagggtctcagcttctcagattctgcccacctgcctctccccacctatgtcacctccacctggagaacctgcagggctgtgaatcccgcacggctgactcagcctgttgcac

SEQ ID NO: 333 - DNA, 2757 bp, Homo sapiens
agtcaggagcgggtgttcagagtcccagggcgatccagtccctgcaccctgcaattttatgaccctggtgcaagctgcagccatgggtcctgagagccgcgccatgtgtaaacatgcgccaggctccagatgatcgcagtgataaccgcgtgaccactccgggatcacgtgtgagtgcaccttctccacaggtcccaggaccacccatcggatcagggatcactccagactcctctcctagaggcgctgccaccctggaagcacatctggcactcagatcatgttcagtcagaaaaacgaagccaccgcgattatgattatgggaacatagggtttacacgggggagttgctggggagggcatttcaggacagccttgatcaaagggctggggagatggtccaggcgatgccaaccggaagccccagaggaggagaggaaagccatccactaggggaccatcgctggccccgagctctgggtgggcccggtgtccggagtctgccgtctgcctcctggaaattcaggcttcctttcacctgggcctccccctcctcccctgagcttccctcaccggcaggccagcccggccctcagggacagctggtgggaaagatgagaatgaacacgtccagcccagccctgagccagggcaggtgcgatagatataggctgggaggccggtctcccttggttctcatctcgccgggttctaatctctcctgaagtctttttcacactaaagccctcaaagccagctgaagcactcgcccgtggttctgattaaacattgttctgacaaaggaaatattatcctcaaagccctaacactacagatgggccccgtgtctctgggtcctgccccgtatgcttggagaggggtttggcgactcagccatgccccagggggaggcttgccggcctgcgggccccgccaccttcctgtaagcgctggtctagctgaatatcaaggtccccggagggccatatttgatgctgtaactgctggtgtcactttacagtgaagacattcattatgtccctttgcagagcatatttgatgcagaggaggccgctggaggcctgagaggagtgaggagaaagtgcaggtccccgagcagcccctgggcgcttcgccgcccagctgtgggcaggtcagcaaggctgagtcgcagggaacaggaggggcctctccaggatccagggccggggcccttggaactcagcagtttccggtttgataggggagggatcaatcacacagatgtataaaatgtaatacagaatattgaattgcagtgaacaagtctaaacaactttaaaatgaccttccaggaagacctgtgatacgatttctccctggtttccatgtattccgtacctacatttaaatggcgtgatgatttattttaagtatctgtgtgtttgtatctcacaccatcccacatggatgtcatcccataatcgtccgatttatcggccaagcgggacccctcctccccccacaggccagggtctgggtgggcaggacctggtctgactcacagcacttgtcaatgatggataaggatgcagtgaagaaacgcatcaaacgatggataaggatgcagtgaagaaacgcatcaaacgatggataaggatgcagtgaagaaacgcatcaaacgatggataaggatgcagtgaagaaacgcatcaaacgatggataaggatgcagtgaagaaacgcatcaaacgatggataaggttgtggtgaagaaacgcagacacaccctcgctctctggaagtttccgtgactgaggttttgggaccaacattgattttaaatacaaggacagcagttttaaggactcagtgtggtgaggactcattggaaataagaaaacgtttgcctactttacagatttttatgttctctaaaataggtctgtttttaaaaaagacattttaaaagggacatgttacattcaatgagggaagaaaatggtaaatgtcagggataattattttgtgcttgaaagcagaagaaaatgaatgatccctgatttcctgaagcatttaaactaaaacagaacagcaccctgctctgtgtaggtgtggagagaagggcatgtgtggacagtgtgtgtgtgtggggagagggtgtgtgggagagggtgtgtggggagagggtgtgtggggagagggtgtgtggggagagggtgtgtgggaagaaggtgtgtggggagagggtttctgtgtgggagagggtgtgtggggagagggtgtgtgggaagaaggtgtgtggggagagggtttctgtgtgggagaggttgtgtgtggagaagggtgtgtggagacggatatgtagtgtggagagagggtgtgtgaggtgccctctcctctagatcaatcctagtgtgtccgatgcttccttccacaggctcccgacacaggtggctaatccggaatcctggtcaacaaagtctgcagccctgcagcctgctgtgatgtttgctgagcagcagagacaggtgaagagttgctctgagaatgccctgatctgctgcagctgtaggtgaaggagcagcttaggatagaaatcaagataagagcaacaaacccaggctcccgcgagaagccagtgggtgtccaacttgagggcggaggaaggcctgcactgcctggacgaggactgactgcggcaaattcactccagggctgggcgtccacgtccagccagaacgcagaacttgccgggttgcgctgctcacacaggcc

SEQ ID NO: 334 - DNA, 1302 bp, Homo sapiens
tgaaggtgctcagctctgcgtggcttgactgcgggccctcaggtgtccttgtccagggctcagcctccccatcctctgcagcggggacattctaagtgagtgtcttgtttaaaaaataaaggtggtaaaaactggagtgtgagaggttaacaagttggctcctgctttactacggggggtccctggcagctcctctgttgaaggacgcatggggcatctgtgccgctctcgtagggacgtttgcagggccttgtgtgactgtgttcacgtcggcccctctcacctctgagctcctccccaccgcgcttgtgagtggagcagcccaggagactgtatgtggggttttccaaccacaaagcatgggggctttggagtctgacgtgctcctcggcatggccacatgtgcctctttctccactcctggccatcagctgccctcaagaagtcagccacccctgcagatggacaatgagtacccaaagccagggaggaagggctttgttgggggagcttggcgtaggcgtccacttcgtcagggcctcagctctttcctggtgattcctgtgggctgatgtacccatcacggggcacagagtgggacgcctgccatgccgtcctccctgcaaaccacagccaacgtccaggccccgcctttcactcgaagctcagcccttgttctggccggggaatctggtgcatcctgctgtgtccagggcccttgctatggtccctggagtggtctcaggggctgtgccacaccgcaggggcctcggatggcccccatgtctcactgagcagacaaccaattttcagtatgcaagtgacaagcaagaagcggcgtcacccctaagccttgaatttctttgccaagcaggaagcggtgtcacccctaaaccttgaatttctttgccaagcaggaagcggtgtcacccctaaaccttgaagttctccagtcctgggcgtccccactgcctccttccgggtcacgtgttcacagagctaggggaagacccagagactccaacgtatcctccaggacctgcagatgggcagaggcagaggcaagtccagcacccgtgccgtgcagtggagacccagagatcaggcgaggtgcctgcatctgtgctggctatgccaccgcagcagcactgtccccagacacctggaaccgtccgcgtgcacaggctcgtggctgccctggcggaggtgccccatgcaccccctcgtctgatgtcaggtacactcctgccccaggccagtgctgttgcaaagctggagtttgtgttcaggctgattatcttg

SEQ ID NO: 335 - DNA, 796 bp, Homo sapiens
cccctgggactgtccctgcccactgcgggtgagggaggccccgtgtgctgtgaacacaggggcctgggcaggagcagggggcaggaaaggaggggagcccctggagcccagccagacgcagagagccctcaccggcctgccgggagcctgcaggctgccccgggctcctaggctctgaggctgggagtgcagtggccgggccctggaggaggctgggctggcaggtgtcattccctctcccggactgtctgggacaggaaggcggtgcatgtgagcacctgggcgcttcattctggagagcagcagcctctggggaagagcaagctcgggccccagcactggggggtccagaatggctgaactcccgggcgctggtccagggctgcctgctgacacctggtcccacatggggcggggcaactccatccttccctccaaaaaatgaaataggccccggggccctctgtaggtgcaggcctctgatggttcttccagcccactctgagcctgcaggaggctgtgcaaacagatgtgcatatgtgtggatgcatgcacatgtgtgtgtccctgagtgcctgcatgtattcccacacgtgtgcctgtgtgctgcatgtgtgtgtatgagcatgagaaaatgggagagggacacatggaaacaaacggagagagaaggaggagtgtgtgagtgtgagtgcatgtgtgtctgtgtgtgagtacatgagtgcctgtgtgtcagtgtgagtgcatgtgcgtgtgagtgcatgcgtgcctgtgtgtgagtgcatggctgtgtgag

SEQ ID NO: 336 - DNA, 76 bp, Homo sapiens
tgtgcctgtgagtgtgagtgcatgcatgcctgtgtgagtgcatgtgtgcctgtgagtgtgagtgcatgcgtgcctc

SEQ ID NO: 337 - DNA, 89 bp, Homo sapiens
ctgtgaatgcatgcgtgcctgtgtgagtgcatgcgtgcctgtgagtgagtgcatgtgtgcctgtgagtgcatgcgtgcctgtgagtgag

SEQ ID NO: 338 - DNA, 1292 bp, Homo sapiens
tgagtgcatgcgtgcctgagtgtgagagtgtgtgtatctgttcaagggggtgtgcacgtgcagacagtgagaaaaggcctcctcagcaactcgagcctcctagagcctccctggttgccagaggggctggggctgctgccttgtccagctctctcctgcccactccactgtgcctctccctgtcctgccatttgccctgggggacagcaactgcgcctggggaccttgataaccaaggagcactttgccgttcccggcgccttcagatacagaatctcacctcacccccgtgctcactcccttcagccgggccaccctaagagcagcacagagcctgcagaggcccctgggccttcacccgtggtgtggtcaggaggcccgagaggcacctggctccatgctggtgccctgtgtctcctctgaccacacaccaatctggtgctcaggaaggcagggcatgcactgccaaagccacggcagagggagacctgccccagggcgcccgcgtgccaacacgcacagtggtctctgtttcattgtgaccacggacacccccaaatttattagcttagctgtgaggcttcctgacacaaaaacatagcaggtttctccttgccacatccagttaggtgcctacggggtgttaaatatcacatgaaagcaacctttcctctgactttttgctcctgctaacttcacgcaggtggattattggatattttctttcaacctcttgcttccccatgccaggggaacctcacccgtttgagccagccgcctctgcctgctgcagctgccctggctgggtcctgggagcctcacgccaggggctgcagccgtgcttgctcccggaggcctgagccggcccaggcccccttccaagtctgcccattccttagacgcctttcctttgctctagggtctccttaaggctccctccagccctgtcactggatggcaattgtctacactacagagtcggtttcacaggcaagcaagtcgatgctaaccccacctacaggctctccccaactccagcccacatgactcccttggggcccctgtctcccctcatccctgtgctccagttaaagtaagccttgtccccccacccccccgccccccgtggcctggcccctgctctgggctctgcccacaccccacccttggacgacctccctcctcttgctctgttggtcaaaatcttacctgacccccaagactcaagcctggggccatctgcagtgccaccccgctcaccacagcctggggcatggtttcagcaaggacta

SEQ ID NO: 339 - DNA, 1089 bp, Homo sapiens
tgtgtgtgtgtgtgtgtgtagtggtagggggggtggcagggtgtgcggacaaaggcagggcctgtgtggtgtgcttgactggctcgggtttcctggaaatgcttccagaatcctgcagggatgctctggtgctcctgccagcctggaggttgtgtcctcggcacaccctgccctgctgcctgctgggccggggacagagacagctcagccctgctcaggggctggaccagcacctgcaggccctggatggagccccgagaaggaaggacatggtccagcggaaatggggcctcacacacacacagatgtacacacagggttcatctgccctatccttcgccggccagaggaggccatacatgttatgaacatgcatcttaaaatcatgcaacacattgaaaaacaaagacttaaaatgagctcagctgatgtccttgccaggacaccactcctctttggaaggtcccacctctccacctatcattgtcattcatgatttctccatgagctgagggtctgtcatcacgtgggcaatgcttctgagtccaggtctgcgccagagcagtgagtggaaatccgaggggggccttgaaatgaccacgtcactgtcgcaaagacagaaggagcaaggggtgctctgagctgcctgaacgtctcacctggggagagtttggacagaacttcgaaaacccctcattcttccattcaattatttgggcatttggtaccttcctacacgttggtgggttcagttcgaatcatgaaggcttttaggggaaggcagctgcctccagaacccactcttggttttctgatgttgttagaaggagcagcggctctcaggggactcccccttcttaaagcccagagcgggtctggcggacgcccgagaacctttgggtaaagtccactccctcccttccctagcaggaaactggagccgaagctcctgctcagggctgctctggtgtcctgcgggatcccacctccagaatcctcttgggaaaagacattttgctcccaagtatttcttcataaagctgaggccctgcatcttggaagacggttcccctgccacctactactagg

SEQ ID NO: 340 - DNA, 641 bp, Homo sapiens
gttcaaggtccctttcagctgggacttccccaggggtaaattaaagggtgtggtggttccctccctgggcctggctgctcttcacagtgtgaccctgggtaaaggtccgtttggtggctccgatgggaaaaaattcccaggcgggcatcacctccatggaggtgacagtatgaaagggatgtgactgcccccagagcaagggtttccctagagggaccccaaaaagctggcaagaaggtggcaagggtgaggaggtggtggggagcccctgcctcagtcacaccaggtggaggggttcaaggcagctcccagcttctcctctgttgttaactgttttcccacccccccccccgctttgccccctccgtcccatctgtccctatgctggaggcctgggagcaaggcctgaacccagtgagagaccactgtgggggtgcctaggtcatggagaaactgtgggccagccagatgtctatggggtggggggtgaggctcaatttcctttaatccgccattcttctgatggggcaggctgcccatctaccaggaaacctgcagggtccttgcaccgggaggggatggatcaggggagacctggctgcttctctgccttctgctattccctttatggggggtggggg

SEQ ID NO: 341 - DNA, 272 bp, Homo sapiens
gggagcagagtggagttggagggagacggtgagggactgggagaccgggatggggagagagagggaggccgggctgtctcgtcagcagcaggcgtgcccagggaaacgcaggtggcatacatcgcatgcataatctcaggagacggccactttaaatcttaattggttgccttttaaatatcatttaagggctggcttccctgcctctctctctagttaagaaggtgtcgtgtcaaactctattaccttgctggacgtctctcccttaagtt

SEQ ID NO: 342 - DNA, 3599 bp, Homo sapiens
tggaatcatcagccgcggtttgagaggtcgataaagcttttagatttggagacgttttccgggagcccatttcctgcggctaagagttgttaatggagcttaaggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcccgccgcagccttttgacaggcacatgagccgcgagcttccgaacctcgataatatcatctcgagcgcgaaagtcaatacggtgacagcgcgcggccggatacaatccaattacgctcggctgcccgggcgctcctggggctcggggtccggcggccgagggtccccctcagggcccggtccaggccctgtcgccagggttcagggcaggccccaccacgcgggggactttggtggcccaggggtccccacgaggccgcagtccgggtccgcccagccccaggctcctagaggaaagccgagcctagtgagtccctccaaggccgcccgcccgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggggatggggaggggagcccggatttctgagcgtagccacggcttggccgggccccccgagccccggatcgctccgcgggttccttccacacgcccttcccgccctgccccgaggcctttcctcccagtcccgcctccggtcggcggcctgtgaagctctgagcatttccccccgcggagccgcggctcgccggctttccgagcagagctgattgcggagcggcgggtccccggaaataggagagccgaggttaggaggtggctgagacggcagaggcgtcgaggccgccctaactcctgcctaggatgggcagaggccgctaacagagaaaagcaacgatgggctcccacgcccccccccgggacacggctctgggaatttagaaagtttaaaatctaatcaaagaaatccctattttttcaaacttctagagttgggtgatgggaagtacgagttctgggtctcacacccacttctattagggagctcagcagaaccctcaaactctacagcgacagttcttttaaaagtggcttaaagtcttgggttgaaccagctgcttttggggagtggagtctgggtcagttcctgctccccactccttccctcccggattagcaccgctttcccttgggaattctcaaatcccctggttttaaatgtgttcattttgcaatacaaacaccatcactcggttttattggttttgttatattagcctctgaagcaggcaattattggtgtgaacatacatcttaaaaagcatcatattatggagtcaagagtgtgcaagagtcaactcagtgcaagtgctgttggtgagcattacgtgctgaggatgaaatcggaggcccgacaggcccaggaggcctcacgcccaggggacagcagaccacgcttcagaacggaaccgccttctccatgtaaacttttgacgtaaactttatgcttcagggtatctggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagtcggcgccgtccgcctgagcgcgggttccctcctgggctcgggacccgcccgcctcaggcgcagaagggtttgccgccggccttgggcagggcgagcagctccctggcggcgcctgcagctggggcgtcctggggcacggcaggcggaaaggcgcgggccaggggtgcagtcagcacgttcgcgcccgcccccagcgagcgtcccagaggcccggggtccaggagggcgcccttggcggtggcccaggcctggttcaaagtgctgtgcctgaggatggggtcgtggaagaccccgtccacccagtttctgagactggttaccggggagtcctggtgcctgtccagggcgccagagtggggaagggccacagacggggacgtggcgggcgcggaggacacagccgcaggggccgcgggaccttggcgcttgagcatgcacgacggaaactcagtctggctcaggga

SEQ ID NO: 343 - DNA, 589 bp, Homo sapiens
tgtgtgggccagggaccagatgcgcggcttagcctccaggcctgccgacgcccccgccggcacaaaccccagcttggcctcgcagacctgagggccgccctctgcgcccggcagtggctccggcccggccgccgcgctgcggagacagctccgggccctctccaggtcctcgtccagagcagctccgccacccgcggccagagacatccggagcgcgcctgaggcctccttgaccgggccgtcgggcgcggcggggacgcgctccagaccgccgtccagggagtggaagggcggcttcagctcgcacgccggcggctctgcttccagcgggtcgaagtcgtccaagtcactaagctccagctccttctcctctttgcccacgggctctgcgggagagaatgcgtggccagtggagggagagggttggtaggtgaatcagaccccctgtccccgtccaccattatgaggcctgttcccgacgctacgaaaagcactcggggcctctcttcgcgtctcccatttcctccagaggccaccaggtcacaaactggcaacacaggggcctccaatgggggaggggggtgtctaa

SEQ ID NO: 344 - DNA, 205 bp, Homo sapiens
gtgagccaccgcgcccggcctactatttttatacgtgatttgagttcctttaaatgctcaggggtcaccaccacagtccccacattggtagcctgaggcagaaccggtttgcacggtgaccgcctaggcatggggctcggcgtttgggacccccaagacgtcctagaaccgcagagaaggcactgtgcctgcactccagggcctc

SEQ ID NO: 345 - DNA, 424 bp, Homo sapiens
gtgacttgagagtgactgtagaggctacacagaaatctctgtgaggggcatgtaattgtattcattcaacaattctgctatgcttctcagattgcagaaaaatcactgctcaaaattccccacttgtcaacttatccttaagacatttttcacaggagctctgatcatcatcaccccacactttgcaccagggctgtttcagaagcagtgttgctcttcctcacacattcagtccagcacagctggtggcagtcggcagacctttgatgttggagacctcttaggcacaggagatgtgtatgctgggactcttctaaaggggagaaggaagctaaatatctcttgcctgaattaaagtttatgtttctgccatatttctcctagctttctcatactccaaatcctctcaagaaggaataaagta

SEQ ID NO: 346 - DNA, 1013 bp, Homo sapiens
ggcccacatttttctataactatgtaccaagaaataatgggctaagaaatcctacctgatgatggatcatccagaccactgcctgattcaacagcatccccactataaagattatttgtaagcagactatttgaggcacagggaatggtcttgtttagagtgggtctaaactaccattttgatttagagacatcctggaggactcagttcaagtttatatcaatcacagatttggtaggagagaggggttatatttattaaaaacttcctaattgacagttatagactatataccttaaatatcatcttgaaacctaccttcaggattttaatcaggttagcatactatctggggaacagaaagaggttcatagaggagagctagcatccctctcaaattatttggaactcttaattttaggatgaaggagggataacctagacttgcttttttttcttttgtccaagggctttcttgagtcaaaagaaactagcttgggtgattccagattgcaatgaattgtctggattcaaagtcaaatgggttcaaattcgaagcatcccagagtcatcaagtgagtaaatcagtcacagcaggtcaggacatactctgacactctatggctgctaattttactggtaccacttagaaagagacaaattgatactccaatttaatgttttcaagtatatgacttcagtgactaacactattattagaaactaaagtttagattcaaagcatgtctagaaatgttaaagacctttacttttttcaagataagaaaggattataccagggttagaagacttattcttgggggaatagcattaaaacatagctcaatgttagaaacaggtgaccatttacttatgagaaagctgaaatgtaaatagctttgtaattcattaccattttgggctagtggtgttcaatacaattttcattcataaggaaatggaacatcaagcatccaggataaaaataaaatatgactcaccaaaatagtggc

SEQ ID NO: 347 - DNA, 470 bp, Homo sapiens
aaaatagcatttaatgaaaggttatttgtttttattttaaaatcttaagcacattgtaacattaccttgaataaacactgctattaaccttcagctgtaaagtgattttcaataatgagaagaggcataatatccaagaaaattttctaatacaaatattgtttagagagactaaataaaaggtgagactctccactgaaactggccaaaggaagatgcaaattaagaatttacccaaaatagagtaggaacccattttattagaagtaaagcaaaataaaggcttcaaccacccgaagtcgcataccagtgatttaattggaaaggtcttttcttataaagaggattaattccaattaacggaaaattcaaattatgtttataaacactaacaaaacattatcattccatagcatattacttgcacagcacctatcctataagacattttatgaaagacaaaggttcat

SEQ ID NO: 348 - DNA, 614 bp, Homo sapiens
catttagaaggctgcaagtttctagagaagctgaagaaaatctttcccttagtcctttgttcatgatattcctctaagaaaaaaaaaaaaagcaagtcccatgtagcacaaaatataaaaagtgaaagctttgtaaggatctattgcagcaaccctgaagagatgtggaattgaaagtgagaaataaatacttacaaatgcaaagacttaaattcccatctctctggcccttctaataaggcatgaatggaagggttctgcctcacccagggaaagaggttcttgatacacagctcttatgcttgcagctcttgacatcttctttagcactttgaggacatttagcatccttgaagcaagaaagttcatgccattgttgacactatcagccacattgtgacctggcaatgtgaggtttccttacggaggcctgctctcaagttatagggccagatcaacccctgacttgctgttcctggactgggagctaaattataaaaagcccacagcccaggaagtagtagctaaaagctatctgagcaaccagcagagaaatgtacctgctaagattctctaagagcaacccagaagccactgttgtcattgtcccaggc

SEQ ID NO: 349 - DNA, 78 bp, Homo sapiens
gaaaacaagtcccaggggactttggttgttgctatctgtcttctgaaggagctcctgtagttacccagcagggcccag

SEQ ID NO: 350 - DNA, 50 bp, Homo sapiens
cactttagacccatggttctattctggctggctgcaatgtggagtaaagt

SEQ ID NO: 351 - DNA, 165 bp, Homo sapiens
ttagtaagggacaaagaagagtctggcagagttccctgtgttgaaggttaccaacagtatcttaatcacgagatgaaagagatttcttaatgtgtaaaaaggaggattacactatctgctttataagatgattatgcctttctggagtgggaggaagagagaaaa

SEQ ID NO: 352 - DNA, 1068 bp, Homo sapiens
ccagatcactcagggctggtagatcatgatcccgccaacccccttccctgttccagcaggaaggatgaaaggagtctaagcaaggtagcagaacagacgaacaagtggaagtgcaagggaaatgtcaggccatgtttattctaaaccttctccaaagggaccaccacagcctagagacactcggaagggaaagaaatacatgtgttgaagaccaagttttccagcttggtcaattaagatgcttggaaagtcctattcctggacaaccatgctttctctttccctccagaagaattacaaacctgagtcatggaaagagagggtttttttggttgggttttttctttcaatattatagcccattccaaagtaaaattgacaggaggaaaactgtgtaaggaatgagtagggagtggaaaaagctgccaagacagtgcagagagtggggaggtggggaagcaagtcagtaaaggaagaattgcttttctgccttttttttttttttctttttttacctcctggcccactgctaccccttcatcctcatcccaaaggagatgggactggctgagtgtgggattagatggccccaagggaagacagtttctacctcttgtccttcctgaacttgctgcatgttagatttttctcctggacaaagatacacctatacaggaagttccccttctagtggggagaatgtcgtttttgaaaattctctttgataattcctaattaaagttcttctgattttgcctgcaacttagtagttccataacttgtctaggaagaaatattttgtagctgaaagcagatgggatcccagtagtaggagggggaaatgtgtctcttccatgaactggaaaagtctgagttgaaggactggttgtatcttgggtacctcttaccgctgggtgggacttctctctgggcttattataacaaacataacatagctctctgggctcagcataacaaacatggggtaaatcccagatccactgcttatactacaggaccctgagagagttacttagatatgtcgaaaaataaatctcctataactct

SEQ ID NO: 353 - DNA, 369 bp, Homo sapiens
tgtttatcatgggtaatcatcaaagaaatttggaaaatactgataacttagttcctagcttccattcccactcagaagtcagagaaaaagttaaaattgtacattcaacactgctcagcatcttttagattccagtggtctattttgggagttggtatgtctgttcctctcctccctttttacttccttctccttcctgttgggccacattcctcctccttccttggggcagtctgccttggtctcagcggtattaaagcttcaggaagacaaaccaaccaacaataagcccctaacatcccaagacttatgaagaggagagaagacagcaggaaatgcttttaaaaataatatcccacactacatata

SEQ ID NO: 354 - DNA, 504 bp, Homo sapiens
ataattgtttaatatttaaatgcttacaacattttaggtactggatggatatgaatacttttcctctttaggctcttgtattgttcatgttttgtgctaaaagaatttctccaagccagccctagttctccgggaacttagctgggagatggatgtgtatggtacatggagacagcaaaatgaaaacaaatcaatacatcaatggagtggaaggtatttatatcatactcagtcaagtgtgttttatggcccacagccaagggtctaagatacctcaactgatgaatcccctaagaaactagttccaacatattcagattgaaaaaaaaaaaaaaaggactgtacccaattacaacagtgtgggcacaggcagggccaaccaaccctaagcaaatttgagaatggtgacatgtccattcctcagccccctacttgtctgtcctgctccctagttcagggcctggtgacagtcctctgattgagaacttagttgtcctcatgctg

SEQ ID NO: 355 - DNA, 117 bp, Homo sapiens
tcatgctccttttaaaacacacccccaccaaccatcctgagaagattctaatggcatatagaataactgacactttaaccaaaacccagtcccactcaaggtatctgtggggagagt

SEQ ID NO: 356 - DNA, 267 bp, Homo sapiens
tttttctcccttttctccctgaagaaccttagcttagcctccccagtgtggcacagtgggtaagtgaggaacggcttagaaggggaagagggcccacggtctggcctgcccacagggcatgccctgtctagctgaagaccccctgaccagttcctaaagcaagtgaggtaggaaaagatgcctccaccagaactaaagcttgtccatgtgacaggcatagaaagacctcaacccccaggtcattatgccctaacctgtcccctacta

SEQ ID NO: 357 - DNA, 47 bp, Homo sapiens
ttattcagggttattatagacaggagaggacatactctcctcacata

SEQ ID NO: 358 - DNA, 163 bp, Homo sapiens
tataaaacaactttatgtttaaaaaaattaaccatcgcaattgctagatcctagagcagacccaacacaccaacattaacccaaatgttttcaactccagcactctttcaaaattccctgagtcaaaatggtatgttgtagcacattttaaaattttaggggt

SEQ ID NO: 359 - DNA, 102 bp, Homo sapiens
tacttaaaagattttaaagattgcttatggttgtaattccttcttatttgacacacagaagcatcataatatattggggttgggggacaggaagttttcaaa

SEQ ID NO: 360 - DNA, 114 bp, Homo sapiens
tgggaggaactggttcaagatgctaacatggatgcgactgatattgcagaatgggacatggagccccggaatgacactcaccagtttaatagccacactctgattacttctttc

SEQ ID NO: 361 - DNA, 656 bp, Homo sapiens
tgattacttctttctgatgaagggtagcagtttggtgtgggatacaaacccagtgcccactttccacataagcctttctactgcattaatagaattctttgctaatgtgtgctgtgaaatatatacaataaagtgtgattggcattaaatcactggtttctatttccacctctcctattcctccactccaggacacatgggagggatgagggaaagagctggtatctgggagataaaggtaggtaaagaggggaagtgatgcaccagaagatgaggaacccaggctgaattggaatattggtggatggaagtgatgttggatacatggaagtgaaatgggactgcactgtgaagggcggcacatcatgaggagcctcccagccgcctggaacccacctgactattagggctggtcatgcccatgaagattagggttttgggttagggttagcttgctggcccaaggaaaccttgatttgtagcctttgccaatttccaggatacaaatacctccaccatggctatctttaagttaccaacatctgaacaagctgggaagagatgcacacgagtggctttcaagagccagtgccagagtaagcctcttctttacacagcagaaggaagaaattaaggcctaaagagatgaaaaaact

SEQ ID NO: 362 - DNA, 29 bp, Homo sapiens
tgctttctaaaggatggagttcccattgt

SEQ ID NO: 363 - DNA, 333 bp, Homo sapiens
cattgttattattgccttttgccactatacctagggtgcctttcagctctaactttatacaaggtgaatttctaggaagtggcttatttagaagtgcatgggtgtatagtgtgctataaaaatatataatctgtttctaaagccgttattttacatcagtatcccagagttggagagattatgcccttctgcatttatgtcttaattgatctaatcattcccgtgagactttctgaatgaagctgactaaaaaataatgtaattgttcaaagaaacttaggaggcctttgactagcaattcttcttctaggaatctattccattaagatattc

SEQ ID NO: 364 - DNA, 707 bp, Homo sapiens
aaagtaaatctgattatttttaggataaactcagtcacattaaaaaaaaaaaacaagaaaaaatccatgtataaattcactgtatataaacaatagaaaaaggtccagacagcttatgactgtgtacaaactatgaatggtagtttatctggagggaagaaataaaatgggaatgaaggtgataagcaatttttatttttaactgtatatctattttatttttttacagtgagcctgtaattgtgcattccttgtctaattttaaataaaacactttttaaagagattccaggatgtgattagatatatagttatatagccttaacatacatgattcaaggttttcaatagcagactttggaaggggttagaaagtctcagaaaaagaaagagattgaaagaagaaaagaccatatattgacgtagtgtctcctctgccaggtctcttagcagttctcttttcaaataatttttctccaatggctaaacttgagttattgagcagaaattgtcctttattctatggctaattggaaggaccagtagctctttgagtggactatattaaaattaaccttgaatcccatatataagccaaggctcaggtcttagtttgtcaatacttactgagccacttagctcaactggtgaaatctggggtcagcacgaagcaaatttcaaattgttaacctcttatttttcagggt

SEQ ID NO: 365 - DNA, 306 bp, Homo sapiens
tggaataagggagcttctggtgacttgggccaagtaagaaagaacaaaaaaggcaccgctctaagattgttttttcacatcttctacaaagtaatgattaacttgagctgacaaattattattttaaggctaagagtcatcaataccttagcatagattaatttagttaggcaattgtttttcttttttcctgacaactaagatgtaggggataagaaaactaatcagggagaaaggggaataatttgtagtatggggcaccaaattttatgtggggagggatctctagagaagcatgtgagaaaa

SEQ ID NO: 366 - DNA, 2631 bp, Homo sapiens
atttggatagcaagaaagggtagccaagaagacttgaaagaaactctgtgaattgaaatccatttaaataagtgtcaataaatacataacctttactttaaacacttacggtttggatgatctcctgggtgtcaaaagtttgagccagccactttctggaaatgggttgcttactaataggcatatcaggagctgagggatacaggaaaggatgtagaaagaaaccaaagggaaacattattccacagtgacagaggggagctatgatacctgtttctcaaatgtattcctgtgggcaagacgacagaagagaatatgtgtgatggctcatccccattctctttaaactcagcagacaaccccggtgggcatgttaggagagtcagtcccccatgccatctttctcgagcaagaacctggtatgttaatgccaactgtgcctcacccataaatagcaatgatgctacaaataatgaattagatgagggaggccagtcctctgatggaactctcaatttaaatagagggcatttgcactgagaatggaacttgtgaaaggcagagccaactgaaagcaggcagggagattagtttctgtcatcagtcatcgctgacactgggcatttctgagattgttgtgatggtcaaggaaaaagccttagaggagaaaatgaatcttttagaaagatgtgaggttgcttaatctggaagacagaggaggggtttgaagaaggaggagaataagactggagtgaagggagagaaaggttactcgaagaggattttgaactgactgaagcaaggtgaggaagaaaaatgagtttgcaaaagttgagatacagcttgacactggtaagtgtggtggtggtgatgctgaggacaataattacaaagattataaagattataacattaagctacccttacagtttatatattacttccacatttattctttcacataattctccctgtgataccttgggaggacaaaagatggtaaacaaatcatcagaattcacttgaaaagctgtcaatatcgtaaatgcagagtcagatgctatgtttctaaattatttcagactcatcacaacttcaaatatgttcttaagtgtctggcaaatcaaagattttgctattaaacaaattaactatactgcttttctaggactatggattaaccatcacaaaaagtgtcttatcatcagtcaggtagaaccttcacattccacagagcaatggtgaaaaatccaacccactcaaaaatggtcattcaacgtcggtaaactttctgtacacactgaaaaatgtccccctctactaaacattattgtaaaatacttgaaaatctaaattgaaatagtttctataagagcagatataaaggattaaaataaaaatggcaaggacaactgcaagcaaaagcattgcagagtcagcaaatattacatttaactccacattaattctcagaaggaatttaacgcaatttccttcattctaactcaaaaattaatttctgtatactgtccttgagatttggattgggaatgaaaaagagaaaactattgaaagtatgaaaatttgacatgaattaatcagccaagagttcagacactggggactgaagattaaactttatagtttagaaacccaagggcagtactttttcttataagtgtacctcacataaaaaaaaaaaaaaaaaacctctactaatatgtatatttcatttacaacattcaagtgaggaggtaatttttatggcattccaaaaagaaggtacaaagagattaaacaatttatagaaaagtcaaggaggagtcaacgctagaacaagatggccctaatcccagcattatcagtattttagacacaaagataatctcattcctctacccattcatgttaaagcctatggaggatgagacatttgagccttaaagactcagagaaagaaagttgtcattgtccatggggttttggcactcagaaagaaaccttgaaggtcttagtcgttgctgtgttattccaggagtgatggtggttgcacagccctatgatcatctccgtccactgctgacagcctgttgaagctatcagtcactgcctgaaagaattcagtccagaagattaaagtgtgaggtttgcatatagggtcatctgccctggtcttccccagggaagatgaacacaagtactctatggggctaacattcagtttagcctacatgcctctgtgcagtaaagagcttagtttgtaaaagttgcctaatccagatatatagagtatctgttccttttccagagaataatctaaaaaaaagggtgagcaaatgaacctatagaatctgccagccttcatcacgttcaagcctagtcaacttatgaaacagcctaaaacaccacatgctatgtttagggactggattccatatctcatagagtgagtgaacttttcatttttgtcatacaaaatcaagttggtgcacttgatgtaaaggggaagccagggataattcactctgtgctagactttaaggcccttgaggacatagtgattttgtttccctccacatccctctaagactctcatattgcttgatctgtggaagatagtctttttacgtg

SEQ ID NO: 367 - DNA, 243 bp, Homo sapiens
aaagaattggaaaaactgaacttacagaaaacagctgaaagcatgggcaatgtataacatgataccaggaaactaagtatgcacctaaattttaagggagggtcagcattactctgagactggaaacctaagacacaaattgcttgctctgctctttggagctttccaaatattccattccctcattcttcctattagtggaaaaccccaaataaaacagaattcgttcacacttaaagatgt

SEQ ID NO: 368 - DNA, 103 bp, Homo sapiens
agtaaaggaattgaggcatttgtgaccattgaagtgcctctactgagagagaacatttcatcctagggtaatccacaatagtaacctaaaagttaggagtgca

SEQ ID NO: 369 - DNA, 107 bp, Homo sapiens
gtgtgctaagcagtccactgtgcaaatgtggtgtaatttatttaataaatctacacttggggtgttttgttttctttactataaacatgaacaaggatacttttgca

SEQ ID NO: 370 - DNA, 334 bp, Homo sapiens
atatctcttagaacccttctctacttatttttagataggattaatacaacgattactaatttgtgagtgtttcctttctgtacctccgcaatagttttggtctctcctccacctcctctaccttttaggaagatgcattcttggtccaaggcgggagagcctgggtcggaaaggaggaatactttgacaaagaatgtttgaggatcacagctaccacgtatagggatagtgacttgtgggagagggtgaaaaggggcctaacatggtatgtaattctgtgagcccatcagatagggtttggacttgcgtccccacccaaatctcctgttgagtt

SEQ ID NO: 371 - DNA, 124 bp, Homo sapiens
ccatcctttccatgggaaagtgcttgagttattctgaaattattttgaactatgaatttgcttcaagttacatgaactgtatattccaagacaccatttggggactgagcttcatgagtcatgg

SEQ ID NO: 372 - DNA, 61 bp, Homo sapiens
tctgcccacctggtcttggagattcgatgctgatgccacaaaagtggactctcttctgtct

SEQ ID NO: 373 - DNA, 1437 bp, Homo sapiens
agaactgttcatctccagtgttggagagtggaccttgctcttcatccagagtcacacagtggagaactccccatatgtaaaaggggaagcagaggcgaggcagaaactgacagagactgagagccctatactcagcttgtttaaatttaaattttgtttacagtgcttttagcttcacagagaattaaattttctgggtgagtatatgaaaatatttcctttatgatctcagatcttaacagctctgctgtctgcataccctctcccaccttcctgaattctcccagctgaaccaagtaggcctgcattttttctttttaaggatagtctgagcttgtatcaagggctttgcagactatcctttgagttttaaggcagctctggtaccccagaccttcctctcatgtcagaaatgtccttgaccctcagacatgggctctggaggctaattatctcaggtggtggcctgtcaccttctaggctggaaatctaccacctctgaaaatgtttaattttcagtcttttagacaggggactttttctgacctgttcatcaaagtgtgttttcatgactaaggagtcccctaactctcctactgctataggtatattttattactcagttaatttcgactggcctcgtatcatgggatacttgacatttcaataccttaggcattaaattgaaaaacacctaattgatcattttcatacagtaagtttaagtttccctttcctactcaaaagaatgcagcgtagtcttagggacacttgaatattttctactggtctttgaggggctcagtcacctttgctctctttgtctacatggttagaaacctgtctgtacatgttgagcagactggtatgcttatcacatgctagagaagtttctggagggttctctgcctgttctgtatatttcaagaaagccccaatgctggttccccatccatggccctcctccagactcagttgtggaagggggatggggaatgaagcaggtatgaaaacaatggggccacactcttctacagccaggatactccttgcagagagaaggcccagcatggcatcatcaggaatggagcctaggccctggcactcacaggtgtcctggaggagttggagcccagatatgggacatccagtgtaggcaagcaagaagcttggagaccaaagtccctgtgggtgatggagggaaacttaccagagagatagcatctggaatgtttggagactggcattaggtggcagcccaaggaggagtccagggcagagaggctgaaaattggaggaagggggaaggctcctggtctagggctcaggggcagggctcctgcccctgggaggtctgcagtgaggacctgtggccccaagcatcaccataagcaatcaggcagacaaaatgagtcaaagatgtgatctttagaatgg

SEQ ID NO: 374 - DNA, 39 bp, Homo sapiens
gagagagagagaataataacaaagcctacctcataggaa

SEQ ID NO: 375 - DNA, 593 bp, Homo sapiens
gtcaatattattattagcacaactgagataatcaaagcagaagaagccttaaggcggtcttgatgtggaatcaccaaagtggtttagttattcttcagttccctctaaataaggacaagattggtcacagatctggggtaaggataaactacagacagggctcaagtggtagaagagagctgcagaggcaaggagccaggaaaattcttgcaaatgtagttgggagaatcacattttattttctggcaactctgacacatagtcattgtgccctatggcctatccagaatctttgggctccctggggctagtgctagagatgtgagtcatgagagagaagagtctggaaggccctctgccaccctggggcctctgccgtaggctggctcctctaaatctccagggtgagcagtggccacgagagagagcacgcacctctggcctcatgccagccctcttcatggacctgctgatcacaagtgcagctggagtgtgaggcatcaaaatacataccctatttcacaagtcatgccctcatcaatccctcttgcacacattaagacaaaaacatggcattaaaaatagttatttac

SEQ ID NO: 376 - DNA, 119 bp, Homo sapiens
atttaccatcataataatggctaccatcattggcagtttaatcatgtgccaaggtaccatgtactatgtacgtagctaagcgctaaatatcgattgcttttattgctcagttaatttca

SEQ ID NO: 377 - DNA, 863 bp, Homo sapiens
gaggaggggaggaaaatgctttggagtaacgtttctaaatgaaatactgcatttttgacagcagacagtactgtctgctgccttccttggtgagctaacaccaacttgaaacaattgctccctccccaggcagcatctgctttggttctccaaggaaattgattcactctgtggagactctctttgggagaggccaaagttccttacagcttctgggatcacaaaacccttttcaacaagatcccttaggcccaggctcctaaaaactgtgtaataaatttaccatcaaaacaatctcacttgatccctctgagaccatcatgctacaaacaaaggtaagatgatattcctataaatatttctcctgtgaaatcattagagttttttcccctcctatgctaaactgtattcttcaaatttaatataatttcatagttcccctaaatcattcatgggtatatatacaacattcaactgttctacatcctgtcatttgaataagaatgattattaaagtttaggctgattctaaaatgcaaaagcattttactgtttttcatattaaaaatgccataatgaaatatttttaaatgttatagcaattatcttttcaccgcacaaacctgcattgtcaactatgccacattaaaatgttaaatcactactttaatatcaatttatagaaggagagagagaaaaaccgctaaaattcatcttctgtgtggtgggtttctccacatcttagtacatgtggtctgtcatggttgagacgtgctgtcttacacaggaaacaccacagattttagaggtcttagacttgaaataacagggaagtccagggattgtgtatttcttcctcatgt

SEQ ID NO: 378 - DNA, 620 bp, Homo sapiens
ttaggttaatcagctatttttctgggttcccagacccaaacctgcaggacattaatgggatgcaagcaaacctgagcagctgggcttgcaaaaataaaattactttcagaagccataatgcaggttgtatgctttgggcatcagtagtgtggtctcctctattcctgctaggccagctgcattgagctctcagtgacggaggtaatggtagaacattagggcagttcttgttgccctggacaagtgttaatgaggaagaggcatggatatgagagataccacattcaggctcttatctctcaatgaatcatgcacagttctcacaatattatctattaaactcagctgaatgtcttagtcacactgaatataatcattacacagaggactttgacctgtcccattaggtgattaaaaaacaaaaagtacatttttaatagatttcataaagacccaattgtatatgactctctggctgcttaagagaagctattaaatgaagtccacattgggtcagtacctcacttttaagcccttgaaatcacatggtcttattatctatgaagttttcaaaaatgagcttgttaacatcaaaactgaaaatccgctaaatagtactc

SEQ ID NO: 379 - DNA, 33 bp, Homo sapiens
cagtaccaacaggttatgttataaacaaattgc

SEQ ID NO: 380 - DNA, 210 bp, Homo sapiens
gtaaacaaatttcactattcatgaggattttcagtcagaaacgagttaccgaatgggtgcttagtaaatatttgactaactgatttttgctggtgttatctctattaatacatcaaatcagccttaagggatgctacagattgaagacctgtaacctacgataaatttactttgtgttaaggtggacttaaagtaaaaaagtaatgctgt

SEQ ID NO: 381 - DNA, 82 bp, Homo sapiens
taaaaactaaaatagaaaaagaagtaactccttttacctcttcacctccctcatcatattaacatctttgtttagtttggga

SEQ ID NO: 382 - DNA, 1513 bp, Homo sapiens
ctggatcacaccacaaattcaccatgcgggaactaaaactcagcctcccctctgcaagttaaattttccttcttactttcctttctttgttatcagcatcaccatttttccttacccaaggtagtagatgagaaatctaaagatttctaaaaattgctttgggcgatttttaacagtctgtcacatttaatttccagcatatttatccttttaaacaattttaaataattcactacaaagtgaaatctggcataagtcctatctgtcttttactccctgaattactgaagaagccaagacaacagatttctaggcagtttttagggcctgggatggggactagtgatataaccaagaaatgaggaagtggctggtctctgctgttttttctttctattttagagaagaaagcttgaatcattggtcgggcaaataaatactcaactattctctggaaagtcctcctctgtttataagaatgcaaatgaataaccttgaaaaaaaagtcttgttattttatatacaaaaaaatttaacatgagctaaatgttttcggagattgagatttaaaaaaaaaacctatccagtacttgtgggtgcaacctcgtcttccactagtgtaagtattctgtcaaagacctagttgccactctcaaacactgtactcaaagcactcgcagggaaacacaggagatattaaattatagtgtaattaaattaaattatcactttgctatcccaccaataaggctgagacggcacttctgttatgaatctttgcttgcaaatccttttactttgggataagaactccttcctggcagaagcactttgggcttaaaggtgaagttgtggattagaggattgtacaagggttcttgcacccagaagattctaaggacaaaaattaaaactcacttgttttgaagatttttgatcttgggcttttgaataattttacttatctgaaacatgaatctatatagtgcatattggatgatttttgcattctaaatataaagcttcttgaaatctaaaaacagcctttttttgttgagtagtaaaaggaatattttaatgttaggaaattttggatatgcagagaaaatcactacttctgaatgaatgggccagaaaccagtactgaggatctgaagcaagagctgtagggtccaccagagtttatcttctctacacctactatatacacagcacttatgagataccataatgatgttcacagtgtgaagaaaacaaaatctcagatttttaacaatataaaaaagaaaacaaggcaggaaggcacttgggactcaatgttcctctttttaagcctttaagcttcttaagcaagtcccattggatacatggggaagatgagtttcccctaagtaccactcctaaaacctctgaggccacaaggagcctgtgaagctgacacaaagaagtgcccctggtgtactttagatgcatgtgtttctacctgcacatgaaagtgcacattctgattgta

SEQ ID NO: 383 - DNA, 283 bp, Homo sapiens
tatcacactcattgcaggagtacattgacatgaatgaaccatatgtgaaggccctacggaatggtttcatccaccctccccttacccttcaaactctctctggagtctacctggggaacccacatggcatccaagtggcagtggatgaatggatagtggcaaccacaggaagcctgttgagacacatgtgacgataggccagcatccttggccaagagtctttatgcagacctgttttgtagaaaacatgtaagcaagggactattgaaggaatggcttaaag

SEQ ID NO: 384 - DNA, 308 bp, Homo sapiens
gggattctgcactgagaacccgtagtataaagaaaagagaacttctactgtcttcttttgaggttttcaaattcattcaaattgttgggctcagtggtgaggatgactgtcaggtggaggtgagtgactgtcctcaggtaaatgattctaatatcctgagatgagccaatgatctgatgttgggagcagggactgtggaatagctctccaccagggcccttggaaatgaaacacagagaattgatttgctcccctgcttctttgtaaacaatacaacaaagttatatagctacacctctggtcataca

SEQ ID NO: 385 - DNA, 92 bp, Homo sapiens
tggtgtgcatatggttattaaaattattattgggacaaaaacatttatttgctaaatataaatgtatgaaaaataccataatttttgtagca

SEQ ID NO: 386 - DNA, 387 bp, Homo sapiens
agaatttaccaccaaacagcagccaacgtatgaggtcccttgggctttcgtcccatgccaaatgacccagctgatagagcctaagaacagattagattccctacagatcctgatctttgagtatgtacttcaaagtggggtttttaacatcagtttttaaactttgctctgcatgcttgtaggacactagcatattttgacttataagaattaatattttacccattgaaaaagtacccctactgggccacatttttaactatttaaattgggagaaaaaagctgaaatacccagagttcatggagaaaaaagtgaaataggatctgccaatatctgtcagtactccataggaacaaagcagtggaaatgaaactcagtgtttgggc

SEQ ID NO: 387 - DNA, 346 bp, Homo sapiens
cagttggcagatcaaccctaaacaggcctcgtgtggctgaggctcatgcattcacaaatccaggtggtggcctccatttgcaaaaaaatttctttgttttgccattctctgggcagaaagtactgccaataatatatgagtaatatctggggctcatttccatttggatgtggagacttaggtctctaaaactttccaaaaaaaatgtccgattgggccagtagggaaagccatgatgcaaccttagtggactcatttatgctttgattgccatttcctgtagatatccatgtttatacattacgaggcataatgtgcttcatcttattatgtgctattattttaa

SEQ ID NO: 388 - DNA, 302 bp, Homo sapiens
atgtatcctatatagaagcttaaaggaagtatgtataatctcagcaagcagtgttatctcatgctgacttaattctaaaagaaattttggtaatttttgttaattctttgttaattctatgcaaatcattccattgaaaataataatgacagaaacatcagagttttaggtttgatcatcaaaacctgtttactgtgaacctaaaatacaacagggacctgttgggatgcatctaaattccaaaggtcatgtggatacgtcctcaaatcttttgtttctgttttaaaatgacagtgatggta

SEQ ID NO: 389 - DNA, 652 bp, Homo sapiens
aaccctgagcatcttcccttctaaacttgaaagtgtttagtttcttcaactaagggcataaccgggtcagtcaggatgtatttgaccacatgaaagggcagcaaaacacatctctttgctttgatttctgtagaaacatgtcccctgtgttaagtggtgacaagcctcgtgggggttttgctcaggcgacaggctggaaatgcatgtgtggcaggcgggcttgtgagatcacatccgaagctggctggactcagttcagtcctttggagtgttgattcagatgacggggggaagaggcgaacccctcttctttggcttagaagattacggatctgtaacttcaaaagctgtttgcaattttatattcacgtctcgctgccaaggtgcttgtcttatctgcagtctgttggctggggcccttgtgagtaagctgggcggtttcctcctgcatttggaaggaagttgcagggtcaaaaaggggggtgggtggtggagaggtgagtgtggctgagaggatgacaccagcggaaacaagggaaatagtctgggaggagggccagacgagcagggtgtgtcagagtgaactcagggagaggagaggaaaggccctttcctagtctgtgctgatctgggaggacacaccatctaaaca

SEQ ID NO: 390 - DNA, 66 bp, Homo sapiens
ctgtttgctgtatggtctgttttttgctaagctcaggtggtaatgttgccctcaatactccatgcc

SEQ ID NO: 391 - DNA, 73 bp, Homo sapiens
gttgagctgttctagatgctgggtgaaatgtgcgactgaacacacagtactggtggactgctgggttctcact

SEQ ID NO: 392 - DNA, 1155 bp, Homo sapiens
ttcttggattgtgcgtttgctctttctgttcccgcctagtgatttctaaattcggttgctcatttagattctcctggttaaaatgccccatcaggcagatttcccatttcataggcctggatgtgacctggggtgaaggcaaggaatcttcattttttaaataaagctttccttgctggttattttgatagttgtgcaggtgtggagaggtggagcaggcatcgagtcacatgggagctccaggtgagtctcatggagctctgagcattggaagaatggagcacagaagagttaagcaacttttctagacatggtcgtaagtttgaaaaatgtagatcaggcctgtggtttctagtaggttgcctaactctttcttcattaaacaaatgggttgtattgtctgttatgatgattctcccactggcttcaggcctgattatttttccttgtggttcagacagctgctccaaaagagtcagatgctgagatccattgtccaccctggctcctgctctgaattgacatcagtttgcaactagcagtttcataaatcaagaaaaagaagaaaggtaaattaatgactgtgttaactagaggggctctgaatttctgctttacatgtactcattttgaatttcacttttattataatgaacttgcaaacacagcattgcaatagtatatgcacctcccaaagatgctgggaaatagctgatatttcatcatttgaggacagtttgtgcctgcaagtggcagaggtgcaggaggagacaaataaaagggatgcctacatcctatttccatgaatttctgtcctctgagctgaaagacaatttacaagttggctgataagaccttgaagaaagaagatattttaaaactttaattgaaaatccccattccttctcattgaagaagcaaaagaagaaactataatgatggacactctggtgctagtatcagtcattttgatcacaagacgtggaccagcccaccttggagctcactgtggtggtggcctggtcctaatgcaagtcctaatggagctcttggaactggctgtagcctttgctgagcaggagcaactatgtctctggttcttaaggattgaaaaggtaaggttgcagttctggatgctggcattacttcagggca

SEQ ID NO: 393 - DNA, 346 bp, Homo sapiens
tcagtactgtaagtcatcctttctctcgtaggggaagatgtgtacttttttttttttttttcttgagatgaagccaaactgaagaaaaacgaacagaaaaaagaatcacaggcccacagcttacatgtcattcatacaggcaggattcagggcctcggcttctgccaaaagaaaaagacattctacacccctatttcttaataataaataacgatttctacagcaacaaatgcttttaactctgcccccatctctgctctatgagccttgaaggcattgcagtttgagacctgcgagttggacctttgtctgcctgtactttctgagaactcatgtaagaatgaaa

SEQ ID NO: 394 - DNA, 769 bp, Homo sapiens
aaaaacaacaaacaccaaagcattctgacatgaaactctggcgcccatttctctgaggcagtacatcattttaaagcttttaatttctagagtaaggagtacattagttgtgccaaatgaatattcaaattgcaggtactccaggatttatgctgattctaactttgagggttgcacttttgagtttaattttgtcttgttttaagcatgggagtgaggggaaatacaggagtgcacaagtaggcaaaagggcaggcatgattgatggccatagaaagtcctgacaaatttgtagtcaatattgtttgtctagagaggattgtgtgacaaaagaagtgtcagcagccactgaagtctcattcttcaggacccagcctccgagttagaatagggggcttgagtgaaatgcctgtcacgcttaattggaaaaatcactccagatgagtgagagaggctgacagttatgcattacagagagaatttagtgtgtcttacaaggttgatacaggcaccaaaagtgactggctttagcttttccctattaggacggccactagaaggataaaacccaagaaaagaagctacttcttgcttcagattcacaagtgcttgtaaaagacttccaccttcattactttcattgtcacgccggtctttacctcaattcctttttttttcttaggttttcattctgtcctggctttcttaaataccagggacaatttcactgggcatacagtggagaaagggaaaccatagacttactcat

SEQ ID NO: 395 - DNA, 1015 bp, Homo sapiens
agtgtgaatgtttgcctgtctttgtggaattggtaatgaacatttccagccattacttccagtgcacaaaggctaaactcactttgtcatttgataatttgtttatctgtcagcatctctcaccctgaaatgatgaggctttgggagagctgtggtttctcatccaggtgaagtctgagagcctatggttctataagggctagagagtttgagagcggagatggataacttgttctctgagtcctgggagcccgctgtttcagggctagcaccaccaacatttggatgcttgggtgcaatttggtcatgggtctcttcagtttaattttcatcttcctgttgggtgtctcagcatttgtctctgtgatcgcatagatttttgagaggctgaggacggctgctttgccttgaagcttctgagcctgtttggcctccaagacttcagccaccaagttgttacacagcagtgcttcctttgtgttgtcccttggtgatgtgttgtggttggtggcatttatgaaaaggatgtggccttaaagactgcttaattccaaacttgcataattcaggccatatcctgaactcagttttactgttcatttggcctgccagccttaaaattctttgatcctcagaaagaatttaaatttgaggcacttacattacttcacattttgagtgtgaagagactatatgaatttttcatgttacactatttcgaatttgtgtaaaatatggccatgttagaatagtctattggggtttgtgactgttaactcttacaattcttaaaagtataatctaattcatggagctaagttcctaaatcctactcatagaaatgtgagtgtaaatcttttgtagatgagtgggtaagctaacaagacttggaaagtattttgaggtaaatgttagggctattattaatatctttatatggcacagcctgaaatgcctcagtaacaaattaatttagttgaattcaataaagatttatttagtacctaccaagggc

SEQ ID NO: 396 - DNA, 280 bp, Homo sapiens
tggatcaggaattgaagtcagtgagttgaactcgaggacccaagaatggtaaactcaagccagccatgtgtgacctttaacattgcagaatgtatttatcttattctcttaccttttaaacttattctttcatgaagaaacacataacactgccaattgaagtgaggagaaatgtaaaagtatttcagacatttttgagaatgcccagcgacagcatggaaagtctctatgaatttttttgttcacgttttaccataacacttttaattttcactgttga

SEQ ID NO: 397 - DNA, 573 bp, Homo sapiens
tctaaatatatggtacactactttcgataaataatatctttaaaaaatgtcctcatcttttttttttttggttttatttatgtatagtatgcttacacaatgggatctttgtctatgatatcgaagactttcaatggcagctcattgtccagaatggcagacattctggtcattgtccagaaagttttagaaggtggaatttaatgtattctgaatacagaactcaatccagatatcaaattgccttggtgagatttacttctctggttaaagtatgatgcaggtaaagttccaatcctgattaatgcagttgtggtcaaagtttaattatattttggaaatgtagtatttaagtgacatctatcacttaaatactatcataaatgctgagtcccatggtggtattgatggacctgaaaatatatgttttttcaagtgcttttacaagtgaaaaaatgtagctaaaatgttatttctctattctatttaaaattaggtttcttggaaaagctttcattttctgaaataaacatccccttgagcctggtggtatgtataaatatggattcacga

SEQ ID NO: 398 - DNA, 191 bp, Homo sapiens
cacgagcagagtgacagtgaaactaggaggcttcgtggccagttggacagggatatgtgaagggcactgaattccaggtggtgccacttgggagggaggctgcagggctgtctgtggacctcacctttttggccatcttgacctgaggtttggatgatctcaatcgtgaggaaaaattaagaaaccatatc

SEQ ID NO: 399 - DNA, 79 bp, Homo sapiens
tcattgtttggatgaatttaaggagagggaacaggaaggctgtttaggaaagttgtggacgtcatatatccggagggct

SEQ ID NO: 400 - DNA, 948 bp, Homo sapiens
gtattgctatgaccagtcctgatgtgagggagggctaaactagatactctccttcccaaatcttatatttcatatttctgttcaatgtagggattaaaagggacaaatgcatctaggtcatagccctagagagcctttgattgctttccccccctttgttctactcagtgctcctttcaacttcttgaggcgtgcatcttggggaagaagtgtcaatcttctttttctcaaatacatgtcactaaaaataaagtggcagtgtacttgagaaggtgcgctccattctgaggacccagggagtgtgcttttgctcatgttcttgggaaatggtaatcatattatgcagaaaaccagaaaaggatatgcctaaattcaaattgtgtcagagatttttatgcctaccaatttgttattgtttctatgccttgtattaatataatatgacttgaataagtatttaaataattgtgcaattaaaaagaattatattcattgttagagaaaaaaaggcaaatgcaacagaggcggcataaccacacattatgtttttatccaacttcctggtcgaatcctgccacggtttgctgacagtatgcccacgccacattttttgagagaaaaaaccatttccaggagcctagcttttcttcatcctttcccacagccacctcctgcctctaaagtgcttgaagacacagtaggaaggcaccagagggcattctcagaccatctattttcaaggaaatacagctgggaagtacaaaacaattctccacttcggccagttttggatgaaatggtggtttctaacacacactcagaaacacttggagtctgaaagctgccatgctaaacaaactgccattcaaccttggggtatcagcagaggcatttgactgagtgatcccaattcacaggacagtcaacgttgtcctcagaagctgggca

SEQ ID NO: 401 - DNA, 295 bp, Homo sapiens
atacgaaagaatacatgaagatcattttgaagtctaactctcagtggttgaattcctttctttttttactctccctcccttccttccttcctgattaaaggagaaactgggatatactaatactgtgtttggagtaggtctgctctgaccttctagtgctgaagagacagtctctgaggattggcaacacacactgctcattgtcgagttgaaagttgagcactcaggctttgagtggctttcaggtttattcaggcttttctgactggggcatgcttaccttcttcgttggaac

SEQ ID NO: 402 - DNA, 99 bp, Homo sapiens
ttttgtatctcctaagattagaattatctctttgtattatttggagtgtattggagggaaattttaggaaagcttaccccttggggtacgttttgaatg

SEQ ID NO: 403 - DNA, 397 bp, Homo sapiens
ttggagttacagaggatttgcccacaaatgatctccccaactaattcgtcagttggcaaagccattcctttaggggttgcctttcctagccggaagaggagatgtatatactattgagaatcatagaaccaagagtccaccacactccagtcaaaacgactgattatgttttataagtgcaagagaagggcagagaggaggtgaggaaagtgtgtcatcggaattacctgcagtaaggggcaagaaagggcttatattgcctgaggacagaatttagaatagcattgatgctatagtatttttttgaagatttttttttctcagaatttattatttaaaacactgcacttgactgacttcattgatagttagactttttattgtaaaatatttattg

SEQ ID NO: 404 - DNA, 71 bp, Homo sapiens
ttgggagcatgggaagttttggagacttagttaattggataaaagttgattgtggctagaaaaaagccaga

SEQ ID NO: 405 - DNA, 947 bp, Homo sapiens
aagaaaaaaaaaaaggcagatttggggaatttaccaaggactgtgggaaaggatttggtagacggaagacacagcagctaatggaccactttccctaacctattaggatctactaggaatcattagaagatatatgaaatgcattacatgagacctgtattctgattaacctcacaatttttatctccagctcttcctaaaatgaaaaaccagtgatgaaaagagagttacaaatttcctataaaaggaattcagtacgtctttgctctctgaatacttctttttcccctgggctttctctcttcaggtagacaagagaaaaatgtcaagacgatttctgagtacaaattctaaatgatattccatcctaaagcaaggcttgttgcctccataacaagataagaatcttaattcttatttgatgggcaaagaaatgttattagaaaacagaagcaagcttggaccttcttgtgacatggacttacggtgatggattatgcctatatacaatattcatttttctttttctctttcctttcacagtctttgttgatttgagataagagatggcttctcacatttttctaagaataacaggtttccttctctgctttctggccattctactttccctcttactggttgcaattccaaagataacacacatgtgagtgcttgacaatctggagttgaaagaagttgttatgggcctcaggaagcacatgtttgaaaaattaattaattcatatgaattaataaactagggaaagcttggttcagtcataatatatttatcactagaaccttctaccaaggacagttggaagcagacaaatgacttgaaaaattagaccattgggagcttcagaaaaccggtgctgagggaagagtagacacagcagcagagaaacagctctgtctagataattgtctagctagtttctttc

SEQ ID NO: 406 - DNA, 434 bp, Homo sapiens
ttgtctagctagtttctaataaagtggctgaagctactttgttggaactgcccaagaaagagccctgtcctttattcatgtggggaatctgagaaagaagctcccgaatgctatagacaagtgcatgagctgtttattgacagagggttttcacttgccagttgcatggaagaggttgttgacaggttgtggataaaaggcagaaagtaaaagaaagcattctttcctaagggatggttatgaatgaagattggaaaaggctgtgcaagcatcgattcctacaactcatctcttctagctagtaaatcttgaagatgaatttaagtttaaaattgaccataagctggctgaatttctgttgaggtttttccacagttattgggaatcagacttaattctttcagtgggtttcttggcctctttactggaatcca

SEQ ID NO: 407 - DNA, 153 bp, Homo sapiens
actgaaatgtcatgatgtgaaagtaaaaacaatttgcaatcaaggtacatgaatatttctgactcttatcaaacaaaaaatagaatagtattgaacatgtgcatgtatttgtgtatgttagcagaaattgaactattttttaaaatagacttc

SEQ ID NO: 408 - DNA, 952 bp, Homo sapiens
ggatttcatttaaaaataccttaattcttatataacttttgttctctcaggctgcccctaacttgtccctagaccaagtatggtaactgcatgttacaatatgcatataagttcatgttataaaaagtgcaattagatcaccaatttttgtaagagaatgtacttggtgacaccgaggggaaagaattttgaaatgcaaagttgttacccaaagcaacaaaatccactggcagaatgaaaatgttagtgttcacttagcccaagtggagggccccttaaattcaggatcattgttgggcattgattctgagtagaggccaacagacacgggtcttcgctcttttacaagaacctcctttgggttcctttggaacttctgtgacccaagttcttttaaaaggagaaaatataatcacctgggaataagttccaatcaacctgattcatattagcttgtctttcaggtagaacaagcaccagtatctttacttttccccagtggtataataaaaggggatagtctcaggtagcctccgtgaccaaaccctaaatcttctttgacagtagataatgtggcaatggccttaatcgttctaaaatgttaactgtgcaatgagtttatgatctaaaggcagaatgaaaggaacccagatttctaattttgcacctaatttgttgcgacaggtataaaggggaaatagaggattaagattaaatgaaagatagaaaaatgtagattagggaagtgctgggatattaatttcaaaaaacaaatagttaaaaacatgtgaagtgctgctgaatgtatgtatcaattcttttgtccattggcaagtgtatcagtggtaatcaatccccacatggcacagggcagcaccgtgaaggaagagccttggctctgaggctcaagaactagcagaagtacatctggaactagagcagatgcatcctg

SEQ ID NO: 409 - DNA, 68 bp, Homo sapiens
ttaatataagaattggtacttattccaaaagatcttttgataagactaacatgaatgaagcaaactgc

SEQ ID NO: 410 - DNA, 26 bp, Homo sapiens
aactatatagatggatgatttctaac

SEQ ID NO: 411 - DNA, 219 bp, Homo sapiens
tagatggatgatttctataggagactagggatgagaaaaatccaggtaagctggagtgctttgcaaatgctcaatggaagagaagggatttgagcttgtctttgaaatgtgaatggaataaaccaggagaataaaccagtggggtaaaggcagggagaactttaaggcaatgtaggtagaaatggagaaggtgtgttttgggacctttgaagaaacagt

SEQ ID NO: 412 - DNA, 182 bp, Homo sapiens
cacacgtgttgaaagtgctgaacaggacagcccaggtgggggtgcagatctccaggaaagctattcagtgaggaaaattgggcttgtactgtgtgattatggttaaggaacatgagaggaaacttgtagagcctgaaaaaacaccaaagtgaaaattaaggtttaatttttatactgttatt

SEQ ID NO: 413 - DNA, 486 bp, Homo sapiens
gagtccaactcccgactatcagtgggccctcggatttgttgcctaaattttcccatcgttggtttctttaaatgagggagtcagtgtagatggtatggatagtctgtgtctttccttgatgtattgctaatgtgaggatttgaggtacccagtatcaagggaaaaggggaagggtaaagaattaagagtataaagaaagaagtgcagagaactgagaaaagtttagaaaacagaagaatgaggagagcagggatcagtgggtaaaagccacaaaaagattattccaaaaagaatagggaacacactcaaattaaaagtagtagacgacaaagacgggggagaaagtgggtcctatcaatagtgggtggcagctgccatggaatggaggcttgaatgcctgctctactaactgattactgaatgatgtcaggcaactcacagcctcacctggttggtataaaggtttccgaagataatacagcaaga

SEQ ID NO: 414 - DNA, 752 bp, Homo sapiens
actcaaatacatttcacctaggaagatgtgatatattttaactgtaaatacaaataattaatgagggtaaaactaattagtgtatgagtttaaaataagggactgtaaataaagcagagcaaatggaagactgggtggggtagttgtgtgcactaaaaggtcagtgtttcaacatactaagggttgtttattgtgtttcttcattctccaaggcagtgatatttactgatgaggtaaagctaataagcatctatttgattttcctgccagtagcaccctgacgttgcccacctgctgtttccccctctgaggtcacttaattaaggagtattttttatgtgacacctcattaggtcctccaggatgccatgcgtgggaagctgttctacaagggccctcatataccccacacgtgctagggctgcctggaagaaacactcctaacccaacaagaccctgcatttagcagccctttgaaggccagatctgtgtggccacaggcctggctcttggtccaaatagcagctgccgtggttgtcctttgggttaagacatgacagtcatgaagaggtgtgggtttgagggacagcagatcataaagcactgtagccacagcaatggtttggtgatttatgtctgtgtgactgagccaaggggctgacaaaggaagagatattctattctggcattttatatcagagggaactggagatctatagatgctgctacttgtgggctgtgaaaagcagggc

SEQ ID NO: 415 - DNA, 923 bp, Homo sapiens
ggttgttttagctgaaactggaagtcaggaattgaatcaatgtctccaaacctagtttaagtaatagaagaatctattcaacctggctctgtctggaaagcttggacttgaattttttattttattaacaactttattctctgctatttgccaaactttggttcaggcattttgctgagttgagaactatggaaatttgttgtaattggaggggaaagaatcacatgtggtttcttccaaacctttttccaattcttttgttttttttgttccgaattccatgggaaaattactcagaacggttattttctcctttaatgatgcaacaatgcttggtttgatttgcctgtttttattttctagctgcattataattacattttcccacatgacttatttttttcttccaaattagtagatataaaattctgatggttctttagggagctaatcttcagagattctcttcttgggctatcctttgtatgggaatagatgatgctggacagccaggcccctgcctgcccgcttagtggcaatccatcaccccaggccttttaattagcagttgcaggtgaatcactaattggacctacatttgcatacgtaagccagaaatttgcaggtttacgtttataaatcttagtcacacaggcagggcagaaatattagcgttcatccctcatcccttataattgcctcatcagctctttacaatggattttcctatcttggtacttgtaagtgggtgaaaaatgacttactttattaatttgttagaaaaaagaggtgttttttgaagaagaaaggagtaagaaaaaaacaaagaaaaagcatttaaacagggctcctttaggcagcagcagggagacatggtgcttgaaaactagcagctggtttaatttttttattgctttgagttt

SEQ ID NO: 416 - DNA, 1192 bp, Homo sapiens
gcattagcatggtgagcagtagcaaagagaaggctcttaaggagtttatacttttctgagacagtgaaggcttccttaccttgagcccacattgactctcaccttcaggagcctgaggaaaatccaggcttaatgttggatttaatcaaagggtcagtctattttcagaactcatcttaatggagtggtcccggcacatgatcagagatgatgctgtgggccttcaggtggctactttgctgagcaaggtttatgatcctcaatctgtctggaggcagggaagctcctagcttctggtcgtttctaagaccatcccaactggtcattcagttaaggacatttcaaccataaatactatttgccaaggaactgcatgtgtcaagggctagacttctcatgatagaaaacctacatcaatatcaagtccttggtctgccacacagcaggatggaagtgcaaaggcaattggtgtgacaaatgtattggcttagttaaagagaaggctctaagttatgtatttagtttcatacaagagagaatatcactattatttttaaggccatgatcataggccacagggttctcgggtcaatccagggtggagaacaatcaagtaggtatgggcagtcattacaggcctgtctggcttaagttacccccagcatactttctcataccaggccccaaatgcccgctcttccttgcacgtaagtcagctaaagtggcttatatttttatttgagatgattacagtcctccaattggaccttgggtgacactgcctctgcttctctccttgctgacttcagggctcactgatggctgcactgattttatttctcagtcttagagactgcctcctttgatatggcatgatgtcacttttcccatcattatgtaggtaataacattttccttctcccagtcaagttggttttgcactgcgtattccaatttatctctcctctcccttcctaaagaagcggagttcttgcttgctggggatggagacaggggaagcagagggaaagcagaaaagtcgcattgtgtatcagcttttgttgtaatatgtcgtgtaacaaacaccaccagatctcagtatcttacatagccagacattgatttttcattcatcggtttgtggtcagctctggtgacttcatttcaggctctgggtcaagttcatgtctgt

SEQ ID NO: 417 - DNA, 160 bp, Homo sapiens
tgtatcaataatacaacctactctttatagctgtgtttcaatacagagttttgaaaaatttagcaattatcagtctcagggagaagttctgggccctaaagaattgggaaagagaagaaataagatttatgatttgttgttgctattataaatggggtca

SEQ ID NO: 418 - DNA, 915 bp, Homo sapiens
ggggtctttcagaaatgcaagtaaattatttgagttacttttaaagttatttttgttttctggactttcttttcctgaatgtaatattactctaaagttggactacatagatcccttggcttttattgcttatacacatactgattaaaatttggtgctagacctgtgaagagtttgaagtaagttattactgttactcatttgtttgcaaatgttctcattcatctggtaagcctatgttgtttgctatcatgactatttactccttggaaaagggtatgtgatctttattggcatatcagtttggatgtctctatggagttctgcacagcagaccattggcaagattctgatttatcataagctttatttatcacacaagaaatgcacaactctgtggacatattggatacatgtgctatctgagtttcttttaaaatcaatgctgtgtgacagtttttcccaaaaatgattaaccaacttgaatcaagaattccccaattatatttaatttcaaatattcaaaatatcaaatattacctttcggtatatttttcaatttgaaagttaccttgtactgatgaagaactggttaacattgcctacaaatggatttctgctacactaagtgtgaataacagctgactctgagttgggctaattgtgaactaattcaaattgctgtgtcactgtgggtgatgaggggaggtgaaacttgtctttttccttctcagcaaattatttttataagaatagtgatactttggatatgatgtttatttcccatgaagaacccacattacttgataagtagatttgttttttccatcaaacagtctctgtttcaaattaaaacagcttctttattcttttatagttatttagtaaaatgatggagtgtaaataaattttcgt

SEQ ID NO: 419 - DNA, 447 bp, Homo sapiens
atttgtaacagtgttattagtgtaatggataatgaatgggtatgtgaacatgagagacaaacatataaatcatttggggtaaaattggcctggggttttaaatattcctttttctttgtaagaaaaagaagaattttttttgaaaaatcaacactgagaaatgccaattgtactttgttaactgaccattctatgtcaaataatttttttggtagtacaaaattttaacttttttcttttttaatctttgttgaagttatctggaaactctatctgggacttttgaacatatgggaattgcaaaaactctttgtgcttattcatggtttatctattcacttttattctgcactcatccctattattgaaatcagtggtcctcagccctgaatgtcctttattttaatgtttttattttattgtaaattgacaatttataattgaata

SEQ ID NO: 420 - DNA, 115 bp, Homo sapiens
tatgttgttgagaatctctggactagatctcatttttggaatctcttaaccactttcttctctcttttcttcactatatgaccaaagtctcatcttctttacaaagccatccttt

SEQ ID NO: 421 - DNA, 33 bp, Homo sapiens
atatgtcactgttacatttgcttaaggtatttg

SEQ ID NO: 422 - DNA, 156 bp, Homo sapiens
acaaaccaaaacatctgtgagctaccacatttgatgacaccttgccacactttgctctcctcttctgaattcctgctgcactcatctataccatatcaagatcgatcacttcattgtgtgcgattttgaactttagatctattttgaattttccaa

SEQ ID NO: 423 - DNA, 1225 bp, Homo sapiens
agctgactttggtccttaaaacaaagaaggattccaatttcttatttttaaacaaaatcattaaaacaacaaatgttgtcaactcattttttttttctcagtgaaagacaaaacaaactcaaagttagaatggagagctactgggaagaaatgcatttctgcatctagctgcttcagagtgcattccttatttagatggggcctcatgtgtcacagtacatttctgaaatggttacctgtttccatttggtcttgtgcctactcgtactttagtgacattaatggctactaaggaagtaagacttttggagaaaatgatattctagtcattccaaagttgtattgaatacatttttttttgccatgaaatagccttaggagatctgctggctaataaaccagacttgataatcgcatcatgtgtatggcagaaattatgcttattccccagtgaaataagatttctcaagtcctggtagaggcagatgaatttatcattctgaaacagcagggtgggtcatagcctgggtggcaagctttgtaaatattaatggagattccaaattccactgtgtctgcagtaatttagaagcagtgttagcagcgaagggtcaagggcaaaacaacaacaacaaaaaatgatgtgggtgggacttggatctctttactgtaagaaaaattcttcttttttggaaaattctttttgtctcttcagtgtctgtggccatctgaaaacgtccacatgatgccagaccatgctttactctgaaaatccaccgataaggttatttgacctctttctctctaatttcacagtgtcagtctttgagctgaataatttcaaacagatttgactcccaagagacctttttctttgtggagcaaaccacgaagaaacacttgaatagtgggtgaaatgacgaatactctaaacctcacaaactattaggaatcaatttctcaaacatcatacctaattattctccctcccccatttcaattcaggaatctcaaggttaaggaaaagcagctgaaaaaacagtattcttggttgggttcatgtactgcccatttttcgtttttttataactgtaggatagaaaggagagaaacttctaaaatctgcccctttaattgccaaaaaagaacactcagagaaagaaaagtttgtgctattatgcagagatgatagtgttggcaagaatcatagagacgcctcttgttt

SEQ ID NO: 424 - DNA, 560 bp, Homo sapiens
atggggacaccaggggttttctgagttgggagggacggaagaaggaagggcaggtgattcagctgctgtggtggccccatggccaggagggagaagtggattccacagaggcttcagtagaaggcagagaacttgcaggtgatgcaaagatgtgtttgtgaataatcacaccgggtatgtcagtgctgtcctagtatttgtgcctgtggaggtgcagaagcagcagatgacagtgaatggagggcacttggaattagaaggcaggaataggtagtttcagtgctcagcggggtgggtagtctttgggccatttcaacaggtccaagatgtgtagaacaaatagtttaagaattatgcatcagtctaggccttgttctgtgtgtaaagttattcaagacagtcatctgagataatttgaagaccaagaataggtgccacatccacactttgtaggaagtttaatggttgagctcctttagagtcaaaattcatatataatatgtcatatctatcatgtaatttcaaaattcgtatataatatgtcatatgtatcatgtaat

SEQ ID NO: 425 - DNA, 107 bp, Homo sapiens
tttgttaggtacgttgaagatggagaacaactgatgtcaagacacattttggttgtaagggacagaagtccaactccaacgagcttgccaaggatggaacctgctgg

SEQ ID NO: 426 - DNA, 222 bp, Homo sapiens
ctttatttggggcccggaggaaatggatacaatgactacagcccatcatagaacctcatgtttagaggaccaaatttcctctctccaaaagtgaaatgttgtcactgtccattcaactgatgaaaatcttccttttcaacagaaaaactatcatgatgttgtctgttgggcttcagtttcttacagcagtcatcttaagaattaaactggtatggataatct

SEQ ID NO: 427 - DNA, 1960 bp, Homo sapiens
tatttcttagcagaattttgaaaatgtgccaagtgttgacttggttcgatcacttgtgagaatggagggacccataatgttaataatcaatgaaggttgttggagttacttacccaaaaccttatgaacttagccttccctagcagatttagtttcgtaatttgtccggtataagcaaacactaaagagggattggggaaagttgtgagttgagtagttgggaaaaaggtagtttgcagttttatttacgtctcacagcttgacattttttgtttgccttggagggggtacttttaaaaattcctcttttgaaaacaataaaatcttagattttggataacagatatttctgtactatatacctcacttaagattttcaaagtaatgtttaaaagtgccttttatattttttcataccacattgtagggaaggccagggtcattttttaacacttaactatgctcaatacctcctcaccactataaagtaaggtcgaatgttggttaaagcaaagctgtctggaatcaccctgtcaaaagtactgatttataaccttgctactcacatttcttactgtggtgccctccctcttgttggctcctgcatctttgaagtacagggaaaatgaactaatatggcagctccaatatgcagctaatcctgccaatgatgtctcccctggaagtgtttgagagaagaatttcttttcccagtatggatttatgtaaacatttgttccattcacgagtagcacattaatgcctaattctggaaaaaatacaaagaaaaaaccttttctgcctgtctagacagagtcttgttagtgtacgtctgatcatatgggtactcatgccggtaatattaattggtgggaaatgagccaaggaaagacaaccctatctaccaattaaatttactgagcttacagggtggtttataaagtcaacatgctgggcaaagcttacatctgaccagggaaattgttgttttctgatccccagttggccgtcagccacctcaaacacgagacagatgttggctttactagggtcagggttatcacagggtgggatgaatagtctttggctctggggtttgctacttttcctttgctgatgaataagagcaaataaaattatttctgaatgccttgggggtggggtgggggttagtgttctaaagctggatagggccaccgcataccaacatcccagggacaaacttcccatgtctcagacgttcttagtttagtttgtttgatctgaggtccactgattccgttatctcaaagggcaagggttaatgccttctcataaagataacaatgataaacacaaacaaggtattcactttgatatattggtttcttatccagggatcaaggcaaaaatgtgggagaactgaaaacacagagtttgaagtagcatcaaagtaatttgccagtttttgaagtaggaagttttttattaatgttttttttccagtggaattgaggtatatagtagcgtgaactaaatgaaggctgtgacattgggaggtgtattttgtgtttgctgtgtcaagtgtgtgtggactgcacatgggattcctatccacttgtgtttgtccttgggattggtttagtttccactaggtgctaaggaaactagccatgcaccgtcagctcccccaggatgagagccacacccgagagaaccctgtctgtgggaaggtagttcttgcggggttggggggcagcaggaggggtcccaagtgctgggacttcgggatccatgttggggactgtcaagaaatgtcatctgacactgggcagtgtggggagaagcaggaggctgtgaattagtaaaactttggatgcacttctgggagaggaaaatacacatgcaccctttcacaaggctgaaaatacatagctacatcggtataatttattctgggaattgcctattaaattgtatt

SEQ ID NO: 428 - DNA, 1627 bp, Homo sapiens
ttgccctgggcccagcgataatcatgccttattttgatttctcctgttggtgttatgttcctgtgaacatctgaacgtaggaacgggcaataactagagtataagtgtccatggcccagggagagacatttgcaaaaattaattactcctgacctaaaggcttgggagttatcttctgaactggtcagtcatgaggttaattagcatatcccatccaaagcaatacagagctttccatgccgagagtgggtcttgatgcgattgtgtttaggctccatccaggagtatatgccacccaccactggcctcaacctctacaattagagaggacctcccaaatacatttaagatgactcattctggaaatggaatgatggactgctacttaggatggcccatgcccttcttcatagccaggcctgatatatttagtaaactcatattctttttcaaaaaaaattacctaatcaaatctctcatcagatgagcaatccattgttgatattatgaaggcctttaatctaccataaatctttattagaactcatcagagcttctagtttgagagaaatgtgattatggcactcttaaaatgacattacatcattggggtgattggtttatcatttggagaagagacatcaatcataactagcataaccacacagtaaatgaattcaacctttctaccgcggaacaatgacactgtaattgctcaaaatcaggcttaaaatgaaatcggaaaatgctctttcttcaaatatgatgttaacttaatggaatatattatgaaaaatcatgtttgaggaaattctatataattaaaaatatgtggaaatatattccctttttactttcatcagaacctgattttagctacagagccctttttttgctgcagagattatgttgcatttaattgaactaccttcgcttatgttttgctgctttttatttcatactatgtaatcgtgatgaatattgtattatgaaggacaagaggcttttgaaatgaggtgcacctgctgatagctttttaaaaacagacaattattagggataaaatgagcttttaaaaactatatccttttatgcatatatggatacccaggcaatgatgatttccataagagaggtcagttcatatcttgaggccatctggaatgttttcttagcaataatgcagtaagtgatttcctttcttttggacagtgtatcagattgaaacttgttgatagggtatttatgtcagctttatgcctaatcaagacctcattttggtggacacaacagatctgtgtgttcagagtcaaacttgtccatttttcgtcactcacaccaatttgttcagctcacttaagactgatagcaatttaagctttagtaacaggagaaaatgccacagaaaatttaagggtccattttcatcccaaacaggagctgtgctgatatgatttcttcaactgagggagtgaaggcccaattgtgcaatacccttgttttcagcaggtacttattatcagagagtttgttaaagctccggtcaacaggcagtcattagaaattctggactctggcttagctaaaatgagagcaaatcgagttcgagtatgcgtgtgctcacgtc

SEQ ID NO: 429 - DNA, 1440 bp, Homo sapiens
ttcttgtggaatgggtttaaggtccagggcaaattggggattctatcaagatttgaatgcagttgtcatgaatttaaatttgacataaaggattgaaaattgagtttgacacggaagatgcaaagtgcagagctatgtctgagtgttttgaactgagtctgataaaaggggctgaatttttcaggaggtgtcacagcacaaacaaagtggccttgtgtttgggtgtgttgtgtttagttggttaattacacagaattttttaaatttgtctcttggcaataaccctgtgttctgagaatctggtactactttggtctttgtctctttcttaggtgaaataaaacactttccaacacatcagcccatacacgacagtaaaacattatttcctgctctcctcttatagttgctgttattatttgatgttggtgaagcccatcattaggagggtcacagtacacaattccttcccgaggagcacctgttctatagaaacaaatgggacataaactacaggaacgaaaatgtttttccccaacatgaaaaactcctcaaagcaacaacaaagcttcacctttatggcttgagtgtcattattttctatgacagtggtgcattctttagtgaatggtactaaaaccttgccacctttggagtcaaattgctctaaccctcaatctatgccaatcaagtagatacccaggtacagttagtgagatgtttacgggagtggtgtttctctcccccttaagcattttctttcaaatagctgagctccagcgagtggctcattctgtgttctgaccttctgccagagcgggttgctccagatatgtttcttgtatacagaagcataatttcaaatcctatggaataactcatctggaaaaaaaatctagatcccagcagcagcataatggaggcccctgcagatggaagaatgagactaccttccaaatcagaatagggtttgcagtttgctctcagcatatgatgcagaaaatatacaggcaaccacattatcttctaaaagcactggctttcctctacctgtgaaacattgaggttttttttaaagtttaaataaaggggctttgaacactcattagtagcatcaaactatacacataagaaatgtagtaaccaagatgccctagctaggacatcttggtagatcttatgtggcaaaagagctgtcccagtcagagagtctctgtttgtaactgagcacatgaagggtgccctaaccctttttaaagagcaatgccttagttaattctaaatgaaaatagtatatcaaaatcagcaggctttggggttgcctaggatcaataagttgcctgtctaatttatctggcatcataaaacaaatgagattcattcattcattccttttttgcacctccctcataatatgtaacagcttataaaaatcgttac

SEQ ID NO: 430 - DNA, 72 bp, Homo sapiens
aacagttgttaaaaaaaatttttttcagctataattagatgatacaataaaggtaaaggaaaaatttaaggg

SEQ ID NO: 431 - DNA, 37 bp, Homo sapiens
taacttaatgaaacttcttctccttatatatcttagg

SEQ ID NO: 432 - DNA, 43 bp, Homo sapiens
agcttcactccgttcttcagggacctccactgcagtttctctg

SEQ ID NO: 433 - DNA, 375 bp, Homo sapiens
gagtgtctatagtaaccacctttatttttcactcttgattttggggtcaggatatcaagtgcaaacatcattcactttcccaagttggatttgtaccgcacataagccactttgactccaggttcttccccaagtcccttggatgtctggttcagacattcagagctacctgcggctccttcctggcatccaggcagaggtttggttccagctgcctctcttctggacaggttcttgtcccactgggtagtacaggctaagtccagcatgttatctttgctgtggaggtcacagaaacagccatccctcttgccccaaatgcagagccacacaggacttgggctatcagctcatggccctttttctccctcaact

SEQ ID NO: 434 - DNA, 137 bp, Homo sapiens
taacctcagaatatttgtttggctgattgagatatacaacagacagtgaaagcgttgtattaaagggcatgggttacaattttttaaagatttcttaaaacgaaatacagcatcacaaaataccctttacgcccact

SEQ ID NO: 435 - DNA, 1031 bp, Homo sapiens
ctctgtaagctccttgcatctggctggaccaagctgtcccaatgttagaggctccccaactcctcctctgtatagtgtggatttcatcccaatatctgggacattgtcaaaactaaggcctacacagtcatgcaaagcagatccttgtaacttacatgcaaaagttgagaagagtggttttggtatgctataacacttggctgaaaatgttgatggcaatcccatcaaggagagaaagtacagctccaccaacacaaacctgggctcccaaagaccctcaccctggcctcctaaacaaggtctcccacctcaataattgggaacaaatagtcctcaggactctctcggcattgttaacttgcctagcaatgtaccaaatagagatcagacttttccttcttttcctttgtgccttcttgaaacagacaaatactgcacatgtgcacgtgtgtgcacacgcacacacacacacacgtaaatgtgtagtttgtaggtccagcaatttccagcccaactagggtcaggaccactcttctgcaccatggtgcaaatgagcacacaatcaagatggacaggtaattcctttggagatgcacagcatggaagtgacagacggcagagaactgctctttctcagcaaataatcttgatattgacaaaattctcagggtcgataggcattgtgtacattctacctctccatttctgtccctggcttcttggtacatataaaaagatgtcctaggcaagcccagagactgggaactacaagtgatatcttaacagtttcgtgccctagtaatttttacccagaacttcagcttctcgcaaattcacttaaagagtacattcaattctaactagcttcctgcgtaatattcaatagtaatttttaaaagtgtccccagtcccttgttagggatgtctcaattcttgggttgaatcaaaggatttcattattttagcagtgggtagtttcaacagaaattatagccccagccctgggtacatctcttagacccatacccaaa

SEQ ID NO: 436 - DNA, 61 bp, Homo sapiens
acaattgaagcaatgattgggtttgagagtacttgtttcctaatttaacaaacaatgttct

SEQ ID NO: 437 - DNA, 34 bp, Homo sapiens
gatatatagaaatttaagtgaatttttaaaagac

SEQ ID NO: 438 - DNA, 514 bp, Homo sapiens
catttacatgagattgggcaggcaaaacacttagtacaatgttaaaaccccaaaatagtagctgtttacttctctcaaatatattttattcaacaagtatgtattgatcagggccgatgtgtttgaaatgacatcaggtgctgtgaacctcagtagttaggcattggagcacttgcgtcaaacccacagatgggtctgtatctgcctctgttgattagggagccctgtggagttgttggggctttagctctttttcccaacacagcttaggatggcatgagaacagagaagatatcatgactactattcctcctcatttctaatccagtgtccatctaagcacaggtaccatcatttcctcagagctttcccaaccaacactgcccaactagaacttccctttttcagaattacagaacagctttatagtctgccttattcaatttagcacctcattgcattctgatttgtaatattctcttggcatttcatgcatgtaagtcacttgtgtcaa

SEQ ID NO: 439 - DNA, 420 bp, Homo sapiens
tctaccttaagaaggacaatgttagagtggggcaacaaaaaggtggcagcagcccccacccagtccttcagatttgggcctgttgactgcaggtcactgtaacatttttagatctgagaccatctgtgattgtggatgtgatcacatttagaaagaacagaaaaaataccacagggcatgatgagaaaagaagtgtgtttgtctaacctgcgtcttccttgggaaggacagagaggtgtgaatccaaaataacagttctttcttcatttgtttagtagctgctgtcctgagttgatgttgccttggaaatagttgctttcattgataaatgttttgtagggtacagctacaatcctagggaatgcatgcgcttagtgtatggattcatttgctggagctgccctaacaaagtaccacgaa

SEQ ID NO: 440 - DNA, 83 bp, Homo sapiens
gaatccaattgaatactcagcaggatagagcaactagaaatagctccctatgtcttctctattattgaacccaccatgctcgt

SEQ ID NO: 441 - DNA, 670 bp, Homo sapiens
agtgcatgcagtcaaaggatggaggaaaggtatgcagagggtatttgcaatatccaaagaatggtccaaaaaaaaagtggaggcagaccctttctcacatgctggctccctctatctgcagtaggagagacagagaatgaagaaggcatttctggatgatggcatagtgcaacatgaatggcaaagaaagccagaagcaaacagagaaaaccaatgtagttaatatttaaactctagaatccaaataaactagttaaacatagaaaaactgttttgtgtggtgctttaaaattctagctcaggcctttcctttgattcccccagggccaataccagctctctcttttgtcatttccatcagatcttttgttttacgatttctgttgcttattatccttattcctttctggtgtttataaagccaaagatgagggggcacatgcattcttgatactgaagcatttaggcggttatcacttaaattaatgttttctgctagagttatattttagtggaaaacagtaattgtttctaagacagcatcttggagttgaaccaattctatcagtgaacactcaaccatgggaagctaacaataaaatgcagtgatcaatcgttcttcttttctctcttccactccaaaggcagacttcacatctctttgctttaa

SEQ ID NO: 442 - DNA, 868 bp, Homo sapiens
tgatgatagagcacctttttaacacttcagcagaacagtttccccatagaaaatgacccccaaatttatctttattgcgacttcccacccctcaccctcacttagaatttacaaagatgcctttgcgtaagttataaccttgcaaacctctgcttttgaattgtgttgatgtccactgtggacggagggctgtgggacaggactatcttcctgcatgccagctccccgaataattccacgatgcaattggtggcattcacacttgactaggatcgcatttcaatctgttccatctgattggataccgtgttttcttcccgtctgtggtaatggagcactcgttcccagttcccaaggttattttcatctcaatgaccttttgcatctccctggggagcctgaccattacccacccccctttcactctgtctgcttagaatattgctttacatgtcgctcttcctgtagtaaccactgtctttgatacattcctatcagcgattttgttcctgtgggagcagtgatctttaccagtttgtgactctccctctttctctgtgggttcttctcgtggtcttacagctcagttcaagcaatttgcttttaaagatgaaaagagataggctgggacaccacctgtttacgacattaggatgctgggtttctgatttcttttgctaacctgcgtgccttctcgtgaagactaaaaactggttagaatataaaagatggaggatctgttgtgaaaataattcacagggaggggaaaaagtcatattacactaggcagacttggccttttctgccgctctttattgatctcaaattgctgaaagggttcagaagataaaaagaatctgtgaaacaa

SEQ ID NO: 443 - DNA, 236 bp, Homo sapiens
aaagactgagaactaggcacgacacattattccacttccaatgatgtgctgagtcgccgaatctgtcgcctctctttaaaaacacacagaaacaactttttcctcccaaagggaggaaactaaagctgttgcccctttctggattggtgatgataatgatattaaataataatcatcatcacttatgtttgtgtaatattttctatttcaaggaacaagatcatgtcctttccttt

SEQ ID NO: 444 - DNA, 386 bp, Homo sapiens
atgttgaaaaaccaagagacgtacataaacattcataattctatccttcctgaaataataacatgcctagtaatacctacctgcattatgtcatggccacaaatcactagagtccagtagagactgcccgtttgagatcaggcatgatcttttaatttattcatgtatgagatttgcatggcctttgtagcatttgtatcttcaatctcagttatctagcttgttggcatcaatgatgatgataatgataatgatgatgatgttaccactgctaatgtcattaacaataatctccatctccatgttggcacaccatctttacttttaggaaacactatcatgtgtattacctatttaaatccccactacaaccatctggtgaggaa

SEQ ID NO: 445 - DNA, 268 bp, Homo sapiens
tggtggaccatatttagtctaatgatctcaaactttccactatcaaggtctttttaaattttcttaatgtactctatgttttgtaggacttggtctacctattcacatgtatttaaaaaaaataggttgtttacttattttgtgttacatgaagatatatagatagataggtacctctaacctctactctcaatgatgtatttgtttaccaagtacagttgtaactgctaatagacaaattttgtggttcctttgcacaattactctc

SEQ ID NO: 446 - DNA, 300 bp, Homo sapiens
caattactcttcatttcagtgctttcctagctggacttcttaacaagtacatacaattaggaggaaggaaagcttaagtgggccatgaaaaggtcaggtgagttttagggatcctggacccaatatccttattacatagctggggcttatgctgacccactaagatcagtgctaagggagttacaagcagaattcaaactcaagtttttgttactgtttttatgtttgacacgggagtatacagcatgggagatcacctcacctctggctctgaggttggtactcagaagctgtggactg

SEQ ID NO: 447 - DNA, 1010 bp, Homo sapiens
tgcctgggtctgaagatctatcatcgcatctgagccaggtccttggcttccttctggcattctgtttgacactgatgagttctgagaccttgctggccttgacttgcccacttcctcacagcagcacaggctcagcatgagatcctcttttccagaataacccagagacttcctggacttgattgagttgtagcttgctttggaaaagattccaacttttacaaagtgaaatttcctatgctaagcaaactctatttatattttattgtattctgttgtcagatgctgcaagtacttgaaaggagcttgtgatataacatattcttgattgtaatatagcattgtaagcacattatggactgaattacaacatttcatgagaagaaaagagaagtgctacattaaacgtacacattattcataaagcttctaattccaggaaaattaaacttgaaaaaattattttccagaatggatgatctgtagcacataggttcttataagtcaaatacagttccttataaatacatggaagatatgtgcccaactcatatgcaggcctagagtagtaagttttgcacaacctgaatcaaattaggtcagtcttctaagaaacattcccatgttacaatgcaaccaaactttaacagggcctctaggcagaggagtggttttcctctcttgggtggagaaccaaaaatgtagcactcttcattgtcaaggtgtatagcaaagcatagatcatgaggggagagcttacacagaatggcatggcatatgccatccagaatccactgtgcagctgcttagggataggagtgtttccattttcaaaaccacataagtttcagaggtcaagcttagcaaagcagcttgaaaagtgtgtacttagtaggcttggggaaaagttggaagcccatgccctcattttgcctcgattatagttctgcaaaaaccctctcttaagagctccaaagtctatgccttattcccttccccatttggactat

SEQ ID NO: 448 - DNA, 1224 bp, Homo sapiens
gtgtggaaaaaaatacctctccattgcacaatgagaagtggacatgcaagttatcatgattgtttattaatagcaataacatcccacatgaacagtggaatcagcactcttccccacagaactcagaacctttgtcctgattaactcattatgactgacattaactctgagattttgctggcggcaatgtggagggagagtattaccttttggctaggtttcttcttgtcctgaggtctttttattcttcatcggcacctcctgtaagtaactgggtttgggctgctcagaaattcctgtctgtgataaataagggaaatttcagacaggatggtaactccatagctattcaggccaaagagttggtagaccattaaaaacaattcacatccttcatgttctgggtttaaatatgcatatttccatggtcttactccctccaaaattggtcagaccagttcaaggttggatgacagatgtgagcaaatcagcgtcagacaagttgagcagactttaacttcctatattgtagtagaaaattcctctcataaaacaacgaggcgcacgtatcaagacccctgctgtgtccaattagacttctttaaaaaggaacaacctctttaactctgtgagtttctgggggctgtttatcttttccttttggcttatcacaactcttaaattaccttggcatatgcttcgttgctagtattttcttgtattttctttttttccgttgccacaggaaacaaacaaaaaaggtttttttgttgtttttttttttttagtaagaggcatttcaagaacgtgttagagggagaaagaatgttgcttaatgaaataaagaagagataatttccaaacgcttttaaaactacatagtaggacaatcattcaagtatgggatgcacccttaagcaagattaggtcttatgggtgacagaggaactaagtttggtgtgtcagccttgatttcttattaccctagttcctgcgcttcatacaaatttaagatccaagcaattatgcctaacgtgctcttgaatacggtaaaatcatgcattttatgtagtcagtaataaaaatactgcagtcgtttttccatccaaagatacagtcccattatgaataatgagtcctagaaaaatatagcaaggtagtccaatgcggcagcataatcatttatgcatctaccaaacctctttcacagttcaagaagtttaa

SEQ ID NO: 449 - DNA, 185 bp, Homo sapiens
tggatggatggatggatagatgatgaatggagaaaaaatacttccctcttttggtctttgaagtttctgggtattaccagtgaagatacagagtatagggcaaggttctcatacctaacaatcaggccaaaccagcacgtttaataaaatgttttttcattgcccttagaataaaacccagatcg

SEQ ID NO: 450 - DNA, 197 bp, Homo sapiens
caaattattgtgcatattttgcaaatatttaatgttactattgtatatttaacttaaaaattactgaggtttttcttcttcccaaactccaattaaaaagcaaacaaccaaaaactcaaaacaaaggtgaaaatgtttcttttgttttattctcgtaacttactagaagctaagaggttgcctcttctactcaccct

SEQ ID NO: 451 - DNA, 61 bp, Homo sapiens
ttctcagagtacttttgagactaatctttgatggcatacattttgggaaacaataaagtag

SEQ ID NO: 452 - DNA, 71 bp, Homo sapiens
tatgtactacttcgcaaaatattacttctaattaattaaaacagaggttctcactctcaaatacatacaaa

SEQ ID NO: 453 - DNA, 133 bp, Homo sapiens
acttaaagccctgcgattcctgtttaatgatctttgcaataatgttattagaagcttaagaagctgaagactttttcaattagtttatactgcctttgttaatgcagagaactagataacagggagctcaaca

SEQ ID NO: 454 - DNA, 110 bp, Homo sapiens
atctggctgtgaaggcccttgtctgccttccgtggattatacacaaaagtcagagcaatgtttaagagaactcatggttgagacatgtggcttccaaccattcttcaggc

SEQ ID NO: 455 - DNA, 1173 bp, Homo sapiens
agagaaataaaacatttacaatctaaaatccaatacaaaggtggaaatgtgcccttattaaaaagcacggagacataggaagaagtcctggaacagcaaagagggaaaggtcactccatttatgataactctggtaaaagagtcaaagatgggaagcaaagcaggtgccattatcaacctcgcaatacctttatggatatttttacagatggttctcttagtcacctcaaagagtgccaggatagaagctgggaagtggaaactccgaaagctgttagagaggaattgcctttagaatcacgcttgctttttcctcgttgctaaaacgtccagaaaatagctagcatgtgcgtttccccagcctgattaaagagtgcatgtgcaagcctctaaataattgctgcatgaatctttataaccacccgaaatgagcttaactcggttggtctacgatggcagaaaggcttataatgtgaggctcatcattctatcacgcatcaaagaatgggaggcagaagccctgttccattctcccctcgcttcctgattaatccacacttttagaatatgagtaagggctgactgatgagctggtttagtttagctttgtaggatttttcctccaatttagcaagcaatgaggacccgcactatttctactctttcatttggctcttaagtctcatttgtgccattagctgaactggtaccttttttttttccctcctgctcagaattcagagacttgtccttctcttgtaattataaagtgctcacaatcaagacagccctggtaaacttttctttttggcacaaaaacaatattagctaaagagctggttgtaacacagatgcttagaaaaagtaggaaaaaatcaggtcttaaaaagatttataaaccccattccagcttgtattcatcatcttcctttcttgctatacaccctggagaataaaggatgctatttacaatgatccctgtcaggagatgttgaatacagacttatctgcctgccaggtcacaattacctttaaaatctaaatgaaatgaaggaagagaaaccgcatttttcccagtaatgggatattccagccatagtctcattggcacccacagtctttgcctcatttgtgagggctgcctcaggtttgtcaaagggtccttattttaga

SEQ ID NO: 456 - DNA, 84 bp, Homo sapiens
taggtaggatggtatggagagaacgaaacagagaactaagtttatgagcctgggaatttcagttgggtaatccgtagtaaattg

SEQ ID NO: 457 - DNA, 280 bp, Homo sapiens
gcatctgctgggcaccgggtactaccttaaacattggaagcagcatgaactccagccccttcgtggtgggcaaagtgattggagaggcaagagatttgcacacagaagacatgacttccccctacctcctgctgatctgggtttgtcattgaagagccctttgctatagcattgcttaggactccttagtttactcaaacctaatgaaatgtggttttcctctccataaaccacctttggatgttgccaatagagagaataatttactgctatggttctc

SEQ ID NO: 458 - DNA, 74 bp, Homo sapiens
ttttaatcacagtctagggcctagggaccatactttttaagatgataaaattttggctgggtgcagtggctcat

SEQ ID NO: 459 - DNA, 289 bp, Homo sapiens
catgttcttcctgtaccttcttgcatccaagaattctgtcttttttatcatgagtgtatgaacatggatttaatttttcttcctacttctcattccaaatgccaaatcctgccctgtttgtttccgggaccttgaaacagtgtcaactacttttcagcacgctgttagagatcactataagaattgcagctttctccaagaggaaggttatggctccagcttgaaagcaaagcagattttcatgttctggtcctaccgagctgatgggttccaactaaagagtttggga

SEQ ID NO: 460 - DNA, 1315 bp, Homo sapiens
aaaaaaaaaaagcagttgggaaccaagtttagtgtttaagtgtggaaaactgccagaacatctgacctgtgctctgatagcaccctgagtatccaggcaaccttgatggttaacattttccaaggtttctaatagatcatggtgaggaaaaaattatgtgctttctttagctctctaataaatatatttcaaaatattcttagaataactaaatatttacatagtagaatgagtaagcattcattttccttcagggttcttttaactttattaatgaagtgttttttaccccctaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaagtgagtttgtaaatttgtatgtgttttacattgactgattagaggtaagacagtatggtgaggttggtgacatctgacactggatgactgtaaattttccccaaagactaagattcaggacatcagtatagcatagaagaaagaagagggtttggacccagccaaactggacacttcctagttttccagcttgcctccacaaactggaacctctgaacttcagcaattgttcctatcagtagggttattgtgagacctaaaatgtaattgaagtttttgcatgtgaccctgcccttaattcagttgctttaaaaacgtttgaacatagtagaaaatgtaacagtgttgctcttagtgtttctcatatatagggaataaaagaagaggttttataatagcacttgtctcacaagatttatgagcgatttgaattttacagatctattcctaagcaaaagagccttaagtctttttttttttctttaaagaagactagcaagtaactttccgtttctgttgtagtctgtgcacttccagacaatatttgctgctgctcaaatgattggttggtatgaccctaaagtaactcgagtcttccatgctggatttggtgtggtgctaggggaagacaagtaagtctggaaaatctgaagatggtaatgatatacttgatcccaagaggctacttttcatttgataccatattagaattaagaaagtccacagtttcctttagtccacataagctataatggtgtaaacccagctgagtgattttgtatctatatcatcactgccagggaatgtagccttttaggtagatagtatgtacaaagttta

SEQ ID NO: 461 - DNA, 389 bp, Homo sapiens
ccgtgtttccatacagtattcctcaattcaaaggcacagcatttttcatgttgtaacctcctgtattcactggtgtcttaggatcacttaccaaaaatctgtggcatcttagatttggtaacaaagcctaaatatttccatcctacaaacgtggtcatgcttctaaaaaaccacatgaagtagctcaagatgtttggccagccaatgcgcagaagccctaattgaacatgtaaaaggcagatgagatgtgttaaggtattatcttagatacagattatgtggagctcaaagaccttgttgggaacaacattttctaattgcgtttcttctccgtggatctgcgcttttttgaaatcaaaagacactaggggctaggcaaagtggctctc

SEQ ID NO: 462 - DNA, 275 bp, Homo sapiens
taactaagaagacactaagtccttattatagtgtttatggacataaagttttttaaaacaaaccagtaagttgatcattacttaatagtatcttagtttcttaacggttggttttttggacatttagatgatattctgacacttgcttaaaattactagtgctcctattatggcatttaattcacttgtcatataatggctaaaggattcttgataatttttaaaatttttctgcactcagcagcatgtagttatagtatcctatcccacccgcc

SEQ ID NO: 463 - DNA, 83 bp, Homo sapiens
ttctcacagagggggatgggacttaagaaaaaggtttgttttctttaatgctcacagattctatttttaaatgacattttctg

SEQ ID NO: 464 - DNA, 147 bp, Homo sapiens
catcatcttcctgctattccttgtacatctgtttattgaggatgtgctgtgcatggtgttggttggatgctccacaatgtgtatatgcaggtacacggaacatgagctcctctctgaaagaggctatcatctagagcagagcagttt

SEQ ID NO: 465 - DNA, 530 bp, Homo sapiens
agtcagaatagaccaacacaaaaacaaaaattcatggcaggcgcaggtagggagtaactgaaaggaacagtaattgcaaagtagattaaggaaggtttcctttagcattttgactggtcttcatgatgagtttcattttatcagagatttgaaagttgaacacttaagaagaagtgtatgggctaaagaaagctatggaaatatataatgtatttgtgggataataaaggagttttaattctgtataagcagaattttacagggcaagtagattcttgcttgggcaagctctggaaataaaactttaacagaaagtagcacattcattttggtactctttgtgttagaaaagcatgcttcattgttatatttgagggattttttaaacacccccccccccccaccaaaaaaaggaaaatgatattatatccttggtgttatgtaaacttttttgtttaatacataaaattcagttttctcaaaatgctttttaacagcgactgcccagggcaatgcttattagtgctttt

SEQ ID NO: 466 - DNA, 31 bp, Homo sapiens
tgagtgaatgaagcaagcaagcaactggctg

SEQ ID NO: 467 - DNA, 1111 bp, Homo sapiens
aacaagaggaattagtatacagagaaattcaagtgagattttgtcaaagaatttactgactttctcaacaattctagaaacatatattttgattagtaatttttctaaaaaggtgaaacatctaagccaaacttagtattccaagaaagcaaacaaattaacaaatatcttctttctctgttaggaaacttattaaaggtaaatatgtagagagtgcttttgagggctagagcataggatgctttgagttgagggctagagatgaaagacacttgaaagcacagtgtttcatgtagtactctccttgcttgatgactggcataaggcattgttaccattggcatcaaccctctcttaatagttctcaggggcaatatgtaccttagagatttaaaacatatgttgcagttttgtggtcaggtctctcaaaccttcattttcaaagatttctaagttgaaaagtctgtttcaaaatctgattgggggttttacattttttaggaaaaagtttaaaacacgttcgggtgaaacagtgcgcctcatggatcttctgggagaaggactaaaacgatccatggacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggctttttcctcctttgttaatgtagcttagtatccgtgctgcttaacagcagttcccaaagatgggagaatattgcagactgaaggggtttgattcgtcagctcacatcagagtctacatgtgccatgctccttcttgggagcatttgtagagtggtcatagcagtcagttcttgccacccaaggccattgatgaaccttcagagcaggcaacatgatggcctttcatggcacccttagaaaagactatggttcagtttgtgtggaatttggaggaattgaaaagtcaacaag

SEQ ID NO: 468 - DNA, 28 bp, Homo sapiens
gtttagagcagtagaggagaggtcatgc

SEQ ID NO: 469 - DNA, 160 bp, Homo sapiens
gctgaatcactggtctaggcacatctggcacagtcagatgaaaagtggtaagttcagtcatctagctgtttgttagtctgcctgatgacaaaaattgctttaactctttttaaccactccagctagtaattttttaagttacttttaattgtgcatagta

SEQ ID NO: 470 - DNA, 37 bp, Homo sapiens
ttgcattagacaatcagtacttacatttatctatata

SEQ ID NO: 471 - DNA, 122 bp, Homo sapiens
tcagagaatattttggtattctgtgtttaaggtatttcttgaaatttttcatcttttcttccagttttcttactgttttccttttaattttttgaacatgttaatcatagttttctttaaac

SEQ ID NO: 472 - DNA, 158 bp, Homo sapiens
ttaagtagcttcatcttaaacaatttcagattttaaagttgctattatcttttttcttttgtttctgttgtcttgattctctcctagccctttctttgtagtccccctccttagtatttagttatttcatcttgctcttttatctttttccccccaca

SEQ ID NO: 473 - DNA, 54 bp, Homo sapiens
attacaggcatgagcattacaggcatggctcatcttgcttttttagaaagattt

SEQ ID NO: 474 - DNA, 224 bp, Homo sapiens
tgtttgtattggccttatgcttctttagggctgaactatttaaattttacctgtatgactagggtgaggtccttactcctgaaatatggccctctggccatacttcaatggcgtgtgtgctaatgcccttccattttgccgctgcagaactgccttgtgtcacacagctgctgaaatcactgctcagctctttaattaccatttgctctttcctgatagatttt

SEQ ID NO: 475 - DNA, 778 bp, Homo sapiens
cttaattacttacttgtggcctaataatgctttagaatacttgagcaaatattagcaaaacagtgaatgggttcttttatctactcttaatacacccttgatttcaattaattatttaacgctaactttttgtttgtattttttggtgttactctgtttcctataacctcacaatgttcatagtatgaagtggatataaactaataattgatgcttctggtttcatatctactgaatacactggaaaaaggtattcatgctgacattttacattttacaaattcagtttctcatagacacattcttcattgtgcataacgcattttatattttcattattttgtttgtacattggcccatgtccttctgcctcagtgtcagtgtttattaaagtttattggtaaaagaataccattagatgttccctaccccagtcttatgcctatgagacaccagggcagaagcagcagtcagtaagctatgaaatactgttttgtttttcccaaaggtcttaactgcagaggaattgaatgctgctcagacatccgttgcgtatggctgcatcaaatatgctgacctttcccataaccggttgaatgactacatcttctcctttgacaaaatgctagatgacagaggaaatacagctgcttacttgttgtatgccttcactagaatcaggtaattgtgggtaggcattgttttattgtgaatcaaatgaaagcatatttagttactcaaaaatattttctttttttttttttgaaatgagacgggg

SEQ ID NO: 476 - DNA, 641 bp, Homo sapiens
gctcagcctaaagtgttcttttcagacttatttttctgcctacaagcatctttggaaatacgtcctcttttagtattgcaagttatcccagaatccctaaacctggccttaactgcacttgccgatactcttctagatgctctatgtttaaatacctagaaagtgtcacctgatcccctaaaagaattatatttccatttttagtattatgaaatgctttagatctggctattagttttgcctaatagtatatcgtataataaaatacttcattttataggaacttctttttaatcggtgataatttcgagtggagaatgagtgtgcctaaaaaaagggaacagtggtgattgcctgatgatttttttgttttttttaaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggtgagtgtctttt

SEQ ID NO: 477 - DNA, 1287 bp, Homo sapiens
tccaagtgtctcatttagtagccatattagggatggggtgccattaaagcatttgaattgtgtgggagtggttttcagatttattttattcatggaaacttccactttttccctaacagttgcacagtgaaccatatcatatataaaagacaaaatgtgaagtagcactttaaaccagaaatggaactctgcccaatcagtctacttttctacaattaggcacatgagatggaaccttaggactccaaagaaaacaattggaagatgactgagagtaggatttttccaacaaacacaatgtgtttgtgggtcccaggaggaatctttgggtgtttttgataatggaaacttcttggaaaacacttgttatcttttcttaccttaggctgtcttccctctgtcatattacatagttaatgaagtagccagaattaatgtattataaggcaagtaggcatttgttaaagtcatgcctgaggactgaaactttattagggaaaaaaatcaccactgtgataatgaggtttatagttatttcagaccgtgaggactaggaaaattttttaaaagaaaggtaaaatttactgttctcatcattgcagaccttatatctcttaatagttaaaaacacatttcttaacagaaatgcctttattttttaaattgtttgtcttcatagtttaaggtaaagaagattctagttaaaacccaaaaacatctgtgggttggactatgcacttctaactaaaatttgcaagtaacatagattctttaataatgattttcaaaaaggaaaacaagttaattaacaacttttttctatcttttcaggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggcaaaatgtggttctttaacagctagaattctaaaaagaaaaaaatcacttccacaaatatgcttatatcttgctgagcattaaaccaaaatgacttagtggaggccatgaaataacaggatttatgcaccacagtgagagtgtattgactttgcaggaatgtggtttattaattttaattagataaggaatcccatttgttgaccctgaaagggccccaagaatttacgcctctt

SEQ ID NO: 478 - DNA, 693 bp, Homo sapiens
ttaagagaaggtgacattggcaatataacagacttgggttcgggggaagggggcaaggaaatgtagactggcaattttcctgaagctcaagattaactcttaacatctcattggccagatgccaatcccagttgcaaaggaaggtagaaacctagagtgaatgtccaagctaagaagaggattgctgtgatttccctagaccagtcacaattcatcccctgggcagggcatattgtctcatttcatgaaattggaatctttgtagcagcacagaatatggagattggcagtggcagcgagaggttttggggtacagctccgcacactgattattgagtcagcagttaatggaatctgccaacacaaaactgaaatgagattccatgtaaagccaacacaatagaaaaatgaatgtttaatgagcatgaattgtatcataccatgctgtttctaaaagtctccaagcttagaggaaccttagagaggatcttaatgagctataataatagcttccattcacaaactggtatgtataagtctaacatgtccacattagatcgctgctccctccaacaaacatggggaggctaagcagtttcctctcactctactaactgcaaagacagttcacctagactactgagcccttgggtccgaagactcaggagactttaggaattaaaaacaagattc

SEQ ID NO: 479 - DNA, 230 bp, Homo sapiens
caggattcagtgaggtggaggagaaaataatgaaagactacaggagtatgttaaattaaccaaaggtcatgataagttcgtatactggaacatcatctcggataccccaggccataactatatctttaaaacactgtcttaccatagtttatagatatataaataccatttaataatacagataatatcagaaacctttccttaggaatagtatagttctgattctcctg

SEQ ID NO: 480 - DNA, 176 bp, Homo sapiens
tgattagcctgtttttaatgtgctagcctttggaaaagcaaagccagtttgacttcagataatccttaatctcatgtaagtcggtgggcctttgtgaccctcaaatttgccttcatttgacctctaaaaaaagtcaaaataattttttattggttaatagacaaaacacaattttt

SEQ ID NO: 481 - DNA, 118 bp, Homo sapiens
ggagaaaaacacaattttcagatgttcactcatttatcctaacaaatgggatgatctttctgtgacctcaagcttatttactgcattctaggaaattacaatactatatatcaatagc

SEQ ID NO: 482 - DNA, 302 bp, Homo sapiens
catagtgtgaggaatgaggaaaattaagttggtcagaaaacgtttgacttggtatggaccagtgtctccacgtaaatataaattctcctcattccattctttaatttgcagggacctgtttgctgagctaagatccattacctaggtctctactcagtgcttttccaaacacagggctgcctgaagacttccgtcatccaaagataatctggtttgctggaattcagttactctccccaatcccaccccccccactgagaattctagtgccagtcctaccttccactggcacttcacagggc

SEQ ID NO: 483 - DNA, 110 bp, Homo sapiens
aaagcaactgcgtattaataaactgaagagggaaataaataccccacatgaacatctcaatagatcagaaacaaagttgtccactcttgccacatctacctattcaagat

SEQ ID NO: 484 - DNA, 198 bp, Homo sapiens
tgcacccagcccacacttattcaaataaattttaaaagcagatttaaactagggcataaatggtacagagaagttaatatgcatctacaattttatgctaattttctcatcatttttgactttgcttcttggccaatgtcagcccaaaatggccagtattaacctttctagaaaatcggctaaataatattcagttga

SEQ ID NO: 485 - DNA, 237 bp, Homo sapiens
caaaaaaatacttggtcgcattatagaaatttcactggttaatgagagtacatggggtcatctaaagtaaaacaattttttgctttgttttgttgcttggtttgctttgcattttcataccagtttaattacataaatatacatggtgcttataaaatgtaatggattgaaggggagcacagttaaactcactgtaatttttgtggggattttagattgtaggagtttgatagcttg

SEQ ID NO: 486 - DNA, 586 bp, Homo sapiens
caaatttcagattcttattctataaaatgaagaattacagagaatttctaaggtgtcttgtggaaagaagacctttgcaaaagtaggccagctaagctttttgagcatttcctgaatggcagccactaattctacagtggggaatggagtaagagtctgagccaccaagagacgaagtgtcccccagcagaagtaatggccaaacaataatgacatcccaaataagggattttagctactttccaagtcccagaggctacaaaaagggagaagattctctttttctaattaattaaccagctatattagatatattattgggagttgactaagattgtgagttttagtcgtgttaggaaggaggtattatattttgtcttgacgagtaaatttaaatatatgcacgccaaacagtaaatttcacctgaggtgtttgtgtttggtgcactgatccaggtgtgccagctggcattatgcagtagacacctaggtaaaaacatttactgttccccagttatggcacccacatatctcagctgcctttcagctaggcagggcatgtgactggctttggccagtcatcagc

SEQ ID NO: 487 - DNA, 103 bp, Homo sapiens
gagtagaaatgattgtgtcaaagtccagactaaacatacaaaaaggttgtgagttctctgcactctattcttcagcagtacagtggaggccctcttttttctc

SEQ ID NO: 488 - DNA, 374 bp, Homo sapiens
gcaaatatagctgcacctgtcactggggtggagatcagatccctacagtcagtcacctttggaggtggaccatggcttagagaaaacaagtttcttcatgcatggatgcttaaagtataatgagaatggagatggggttatagagtattacctctggtttcatgtcaatcatggctagttactccttgggcaatttgttggaatggttctgtgagaaaataagcaaaattcctcatgcattttttaagtctatgggaatgattgatgtgcactatgtctactactgaggcctagtcacagatgtaattatgatcattactttagggcacatcttctggaataacaagtcaattgtaaacaaaagtatacatggt

SEQ ID NO: 489 - DNA, 33 bp, Homo sapiens
aaaaaaaaaattgccaggcatgatggtttatac

SEQ ID NO: 490 - DNA, 311 bp, Homo sapiens
gacaccaagtgtagttcatcattttggaaaatattcaccttatagcaagaatggaaacctctaagtagagtattttatgtgaaccattcaacctcaggaatcatacatttcactcactgatcccttgttcacattccagtgtataaaactctggtccccattaaggagacactccagtcctcagggaaaatcagacctggcactgtcgtccatgagtatgagacgggaagagctgtggtccaggatggaacggaagtcatactgcacataccaggtgttcagtaaatgctccgatcttcaggtgcgcgttg

SEQ ID NO: 491 - DNA, 199 bp, Homo sapiens
gagtagacacttaattcaactaacgggaggctggccagttgtttcaccacctatcctactttccccagctcttgtgtggttcccaaagcccctagcagtagccaaaacgggggccccaactgctgtcgctgtccctggtgctgactaaaccctaaagcctctgcgttgcggccttggggccattggtggtgccgagtta

SEQ ID NO: 492 - DNA, 45 bp, Homo sapiens
gttgctgcccttggtgctgcccaattattcttttcttttcttctc

SEQ ID NO: 493 - DNA, 428 bp, Homo sapiens
ctcaagaaaatgctgcagatttagagagtgactttgaagcatagactagacttcgaggatgaacatgacattttggctctctgtgtatccccattcacactgaagaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttccgggccgcagggtcgcggggacgggtgtgatgcaatcgcgccacagccgctgcgtcaaggggcggctccgggatgcgggcactgcggtagagcccgtcctgccc

SEQ ID NO: 494 - DNA, 137 bp, Homo sapiens
gcctccgctgctaaacccgcggacaaccgccgggacgaccacccagagccaccagagccccctgacacccgccccgaggcaccggtaacccacggcacccgccccggtgcgtgccatgaagtcggccgcgagctcgc

SEQ ID NO: 495 - DNA, 41 bp, Homo sapiens
caggggggcaagggcggcttcggggcgcgggcgcgcggctt

SEQ ID NO: 496 - DNA, 920 bp, Homo sapiens
tggccaagagcaagagccgccgcaggaagggcgccatggtggtgtcggtggagccgcaccggcacgagggcgtcttcatctaccgcggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcggggtggaccagatccacatcaagcccaagtccaaggtgctgtacctgggcgccgcgtcgggcaccaccgtctcccatgtctccgacatcattggcccagacggcctggtctacgccgtcgagttctcccaccgcgccggccgcgatctggtcaacgtggccaagaagcgcaccaacatcattccggtcctggaggacgcgcggcacccgctcaagtaccgcatgctcatcgggatggtggacgtgatcttcgccgacgtggcccagccggaccagtcccgcatcgtggccctgaacgcccacaccttcctgcgcaatgggggccactttctcatctccatcaaggccaactgcatcgactccaccgcatccgccgaggctgtgtttgcttctgaggtgaggaagttgcagcaggagaacttgaagcctcaagagcagctgaccctggagccctatgagcgggaccacgctgtggtggtcggggtctaccgacctcttcccaagagcagcagcaaatagcacccagctcaggctcgcctgccatctccccaaggctgcgttgtgtttgctattattttctgtgtgttttctttgtgagtgttttgttttgttgtttttctattaaactgcataaagaaacggcacctatctgtatggtgatgccaggctaggttttgctgcagt

SEQ ID NO: 497 - DNA, 383 bp, Homo sapiens
ccggctggtataaggggcccatccagcagtagcctgggagctgtgctcattctaatcactcaggtctccaactccccagggccccattttcacacatgctccccccatccctagggcagaggaaagagagctgcggaattgctaataaaagcttttaaatgtccccttggaactgatggggcacttctgctcacatttggccaagtcacatgacccagcctgactcgggaaaaacactgaatgttggtggacaataatatagtcaaacacaccaatcatctgactcacagccaaagtcttaaccacaataggtttttagtattttactcttcaactaagcccttttgcattcactgttaaagtgaataataaataaatgttaa

SEQ ID NO: 498 - DNA, 628 bp, Homo sapiens
gggggatcttgtctctggtccccaacccctatggcatgtgcacagggacacacttagagcagggccctgtgaccttattgtgttctttcgccctcccctgtcccccccgggctacccctttgtttggtttcacaatagcaaaacaagatgcggggcagatgtgggtctagctagcagactgtctctactacagggcataacatacccaaagtggtatcaccaagtgtctgcagaacaggcagacaaattactcccagaaagtatctgtctttgcaaggcatgtcctgcacttcccaagttgctggtctcagtacctcgcagtctctctccaaagcagcccaaagggaagggagagtgggtaatccgaggaaagctgagaatgccccaaaggcccagtaaatccctccaagccagacttttcattcattcatgcatgcatgcatacacactcccaactgccaaaaagacccacatcaacatttagtctttgaatgattgctcactaatgtatcatttggagggtggatttgcctttctaaagatgtgcttgggcagcaattgtggttagtctgctttttctgagggcatacttcttgaacaacaacaaaggataaatcagactttttat

SEQ ID NO: 499 - DNA, 162 bp, Homo sapiens
caaatcagacttttgaaaaggctgccactctttcaccactcccccatcctacgccaccccaaaattcagaaagggaattacagttcagatgtatcagcaagactgactcaggaagaagagagtgaatgccgtacatgtctatttccataaacaatggaaatc

SEQ ID NO: 500 - DNA, 570 bp, Homo sapiens
aagtctgtgctggttctgttgccttgaaaagccctctctccaatcctaggctaatttattagttgctgtgatgaagccctgaggctggggtggactccctgggaacaggaactgtttcctcactaggggaagacagaagcagctgggtactcaggagggaggggctctgcagcagctgaggcccatgacccagcccctcctcagagccagatgggctccataaaggagctcttgattgctccttaaaggtttttccccccagcatgggggatgaagcaggggaaactctacctccttccttggcatgggaactcccattccctgcccctcctgccgcaagtgaaatttaaagtcatgtctgaagcttctcaaagagggaaccattcatgaggaaatggcaacaaaacaatctcctgaagaatttccctgcattgcagatgagttcctgagccaatggaatgacatggtgagtaccaggaaaaatataggaataagggccaagggaatacaggaagggagctggaacctggttttagaggatgatggcagggaaaagaatgggactatagt

SEQ ID NO: 501 - DNA, 146 bp, Homo sapiens
ttatcggactgtaactccagtgggccttgggtcccaagaaacctagaagtagcagtgaccctggttaacagacctgctcagagccaggaatgcttcagtgactatcagcttgggttccaagaagcctttacatttgggtctctagg

SEQ ID NO: 502 - DNA, 229 bp, Homo sapiens
cttcaatttgtgaattttctgggacacaattcggtgcataaccctagggttagatgagaatgttcagctaaaatgactgtcttactggattgtgagctttggctgaggagaccagtgtttaatgtgaaaatacctgccaacagcctggcactaagtgctctgcctgtttttttccccccacctcttactgtcaatagagaataataaggtggctgagaattaagtttaa

SEQ ID NO: 503 - DNA, 29 bp, Homo sapiens
gtttaaaacgggcccagcacagtgttcag

SEQ ID NO: 504 - DNA, 227 bp, Homo sapiens
gtttacataaatgccaggggttgccttggagtcgagggggtggggaacacacttagcaagtcttctgaggggactgccctgtgctgggagctggggggagcttgccactgagtttcagagtcagcggctccatcctgggccacgggagaggactcaacccaagcatcagtgagtgcctggctgcagtcacctctgcagcagaggcagcgagggtggaggctggtgct

SEQ ID NO: 505 - DNA, 107 bp, Homo sapiens
aagaaaccatgttccattaattagcactttcccctgccaaccctgcattaagcaagatgttctggctcatctgagctatggtgagcactacattggatactgctact

SEQ ID NO: 506 - DNA, 37 bp, Homo sapiens
gaaaactcagtatttctttgatctttagaagtacgac

SEQ ID NO: 507 - DNA, 146 bp, Homo sapiens
tcatgatttttaaattaataacaaaaacaaacattccagaaagtgccgacactaacattccacttgatgaattgctgcaaaatgaacactggtgtcagagctgcccctagcatttgtgtggcagggagcaagagcatttgtaagga

SEQ ID NO: 508 - DNA, 26 bp, Homo sapiens
agagtgcagtcttttaaagtgcagga

SEQ ID NO: 509 - DNA, 218 bp, Homo sapiens
aaaagaaaaaaaaaaaagtgctgggcccagaacaggggcccagcacaggggcccagttgccaatgactaagagtgtcccctttgcctgtccacccatccagtctcagcattcctctatgaagatgcaaagtctaccccttcccaggagtccttccaggcccatcgactcacaggaagctccttctgacattacagctcttggttagtattcttgatga

SEQ ID NO: 510 - DNA, 37 bp, Homo sapiens
tctggagcagaattgcatctctggtctaagtcagtga

SEQ ID NO: 511 - DNA, 251 bp, Homo sapiens
attgaaaatgctgtatcatttttgtcatcagctgggaaaggcagatttaggatggtattttgaataactggaagacaacagctgagcatttctgcggtgcctgctggtacttggggcctctttgacaacagaggatgctcccagagattccaccaaggccaatgattgaagtcagggcctaaaaacaaagttcttgctactcctgttctttggtcacctgactgcacactgcatgctgaggatgtttgtta

SEQ ID NO: 512 - DNA, 469 bp, Homo sapiens
tggggtttaccttctacagactgtaagtacaggctcccagtacttcagttggttttttggtctcttgagcaaaagcattttatgaacttctctctaaatcttgccttcgcacttttcacttatttctcatgtttgcctcttccatcccctggtgaccaccaagccgcatgtctactgctcaggacacacctatcatccttcccatcccactgcctccagccgagcctctgcttcctgcctggaggactcaggtgcctgaaaacacaatgcaagaattctagctgcttgtaatagccattgtgtttggcagtttttgttgttgttttttttaatctgggccacacaggaaggcttccagaaacattggacaagagctgaggaagaacctgaagtagttttgatggaaaacactgtctttcttacctcttcatgtgattttagtcttctcccacccaaaagtccttccttc

SEQ ID NO: 513 - DNA, 25 bp, Homo sapiens
tttattgaaatccgtgctgaacatg

SEQ ID NO: 514 - DNA, 141 bp, Homo sapiens
tagaagttgttttccttttaaactcaaatctcacactcctctaactggcaagtttggcccattaatattttcatctttctggttttttccacatttaaattgtcctgctttttctgtattgattgctctttcttgttataa

SEQ ID NO: 515 - DNA, 69 bp, Homo sapiens
ctgcgcccagttccaaattatttatttggataacattctggtgccatatgccatttgtccaatacaaag

SEQ ID NO: 516 - DNA, 961 bp, Homo sapiens
tttgaaatctgggataagggatgcttcctgtcacaacttgaatcgctactcttgccatttcattaggcgacttccaaacacaaattcatagagagaagttatcttcctctctaccacactagcaggtgatggtctttcctgttctatctttttggctttagctccagcccctctttatttatttttctggtattttacacgtgccacacgaattcatctaaacaaacggtgaataagtgccatatcgtatcgacgtcttacaccgctgaagggcaaaccacccttttttccaaagtcctttttccatttacccaccaattcagcatgctgcagtacatttcttttcacattcccatcttggtcttctcccacacgtggagacggaaatgctttctcgttttctgttccaagaattactagtaacgagaacacatcctaccccatcagcaaggcccagtgtgatcggtttctctcggcgtcctttgtctcttcccacccacccctcagggactgcgtgaaaaaaacaactgtacagtgaaactaacctgaaattacacgtctactttctttccccggctggcgctgagatgggcaggtgctgcagcagcccggctggaagcgatgcagcatccaggacgacggaggaaggggcagagagggacctctgctttccaggctgccttttatactgcctctggtcacctgacgtggaacgtaccctaacctaatcagttacatgtaagttaattgcaattaacttaatccaattacatgacccggaaaggtctatctgcacagcccactctaagatcatgtccactgctgacagacattctaaaacctacgtgtacagctgcaagctttgaagaatagatgttccccgtcagacatgtaacactggtgcctgtacccctgtctttttttccatcttttttgtttttgtgttttgttttgttttaaa

SEQ ID NO: 517 - DNA, 212 bp, Homo sapiens
cacggtaggtctgtcagcagagaaccctgaccacaccctcatgtgttttctcctccaggaggcgcttggaaaccaccgtcaattggaccgcactgggaaacacagatgaacaaagtcaacaccgctttgtcctgcagtgcctggctcctttttcagctcgtcttgcgactccaggtattggagtccagggaggggtacgtcgcctttaccct

SEQ ID NO: 518 - DNA, 103 bp, Homo sapiens
cacagcagggcagggagcccagatgtgaatctgtagataccaaactttctaatttttcagtagtttccaagcatcttttatttttcttgtttcttcgttggtg

SEQ ID NO: 519 - DNA, 1112 bp, Homo sapiens
atgtcattggtgccttaaccaagcctcttttaatttttcaaacggaagagcccctgtccctcagttacggctgctgagccctttcaaggtgagtcagtgaggagggagaaaagcggaagtggtgtgggaagaggcggggtctgggccagctgctggtcctgctctcctccctcctttggcctctaggctcccaggagtggtttcgaacctgcgccatgtgctctggaggctgtggcaaggcaggcgcggcttggaacccgcaccatgtgctctgggggctgtggcaaggcaggggcagcttggaacctgcgccatgtgctctgggggctgtgccagggcagggggagtcctcgtgtcccctgcgcacaacacagacagaaggctgggtccacccagtgggcggtcgggtgccaggccagtgcttaccccgccatgtttgcagcccgaggccagctggctgcaggtgcaggactaggcgtcaggggtcagggtgcacacatccctgcaggtctcggggctcctgggttgcttctggaagggcacagatgggacctgactggagctgcagaggggtggagcttctggggaaaggatccctcctagggggagtgtcttgggcctggggccacgtggcagggacagagacgggtccatggcagtgtctgctcttctctgtgaaggcaaaaagcctctgagggagtattacagccgcctcatccaccagaagcatttccagcagatccaggtctgcaccccctgactgcagggccaaggactacccccgcttctaggtgagaggccagcaggaggctcagggaggaggcggggccttaagcagggggagcaggggtgggcatgatgtactttttctgaaaaggtggctctggaggccacttggggacaggacctgggctctggctgaactcccgggaggaggctacttcctggtgtgccagcccctccctgccaggtcgccccagaggccctttaccaaggggtttgaggaggccacgtcctttcagtctgccacgccctccattgcatcctcttccttcctccaggagggctgggcctgggtttggggccactgttgcccaggtgggggagggcag

SEQ ID NO: 520 - DNA, 124 bp, Homo sapiens
tcatggcttggtcctgatacgtctctagagctgcatcttccagcttcgagtgagcagagcagttggagtctgagggccttttcctggcaggattctccagctagtctttgttttagacagtctt

SEQ ID NO: 521 - DNA, 79 bp, Homo sapiens
ccaggtagtctttagaaatgttaagctatttggctttattttcacactgacagctggtttgtggtgggtgtgttatggt

SEQ ID NO: 522 - DNA, 487 bp, Homo sapiens
caaattgtggttacgtagaagtgtcaacttacattttcagatgtcccagccaggccgtgtggctgcttggccagcttaagccacttgtgcttggggctgtcgggggccttatccaattttcactcccctcgggggatgttgtctcactgtgctgggaggatttgtgttcccagggcagagaccagcactctgccccacccctcttgcctagcagggttggtggacctgggtgtctctctggacacatcctccagtggcctggacctgcccatgaagttggtggacatgttcaggtgctgtttgcctgcgtgtgccgtgaacttcaagtggtaggagcagaacccgaatctttctggggatagcttcacagatccaccgctgacggggaagcagtgcagagtgagctgcccaaagtgaggccctgccccttggtcagtccagcacacactggaggccatgaggaggagccctgcggttactgtggctg

SEQ ID NO: 523 - DNA, 1184 bp, Homo sapiens
ttttgctcctagagtagaattggcgggaaatgcctgcaggcttacatggttttctttgtttttctctcccaccatgtcccttttggccaagctcacatggtgggtttgaatgagttaaatgagtgtcatgctgtggcctcactccacccagcatagacgggtgtttggaagggtggcgttagaggagattctagaagcagtagccccagcacaagttgagcccttggcccctgctcagcagccggctcctggatgggattcagggatgcgagcccctcgtgtgagctgagctcagggaatgtggggatcaaatctggtgtcctagaaaagtcatcttttatgtgctgaaccagtccccagggggttgcctttacttgttccatggccatggaattaagaaaaacatgcaaaagtaattcttcagtacttgaagagcatccagcacagaaggtacaaaccttccttaaggctccctcctcaaatcggtttggtcattttgatgtgcacccccccaggcctttatacccttcagatgccaaatctaagaaccagctcccagaaaccacaccccctgttccaaaccccagcctggcttgagcgtggggtgggtgggatcccagctgggcaccccaggagtctggtgtcttccccaggcagctctcaggctcccttggttctgtctgcagtttacatgagctggtgaaacatgtagaaaatggcctgatctttgaggagtcagaggaactggcagctcagctgcaggtagccatgtctgccaccacgccagggtgggcagggttctggagactggcattgagccacgctccctgatccctgcttcccacagccagggtgggaccatggggggtctggtggaaaagctagtgggggagcagaagtcacagaggcctcctactctgctgtcccatttcggtacagtaggctcgggaaagttaggacacaaccccacctgccctctggatttatggagctgacactccataaatgatgctggagccgggtgggccgggctgcagtttaggaagtgatcggatcaggtaggtgcgtgggcaaagggaacttctgggaccagccttgaaagatgggtggaattctgcaaaggttacttgtttcttattgcaaaaagtaatacatcattcttgtcaacagaatgattgggagga

SEQ ID NO: 524 - DNA, 1974 bp, Homo sapiens
attcagacagtttagcaaggctgaaaagaacacccacacccccttgttacccacagatgggtgggactgtgttggccagaggccgagaggagggtgctcacaggggaacgtacagcatgtagaggccggaaggtgctccagggcaccaagtgtgggaaagtgggacatacggggaagtttccagaaagcatgatgtcaagttggaggtggagcgctgctgggttgtgaagggtctcaagtccaagtgagggagttagggacttgggaggggttgttgttgggtcggggacctggggtcagccaagtggtgacctgggatggggtggggacaggcaatgagttaagctctgctctttagcattttgcagatgcttttctcaaacttttctgatcctgcaggcaagctaaaccagttctggaagaacctgcaagagtctcagcagctctgatgggatgagagctgggtgcagactgtgctccctttggttatggacacataactcctgggccagaggctaaaaccccagggcccctgctgtccttcccgcagcttcttggggtctcagggcaaagcctttcgagcagcgcctcccagtggccagaagctgaaatgacggcagtggtgtcacctggtgaatgacccgggaagctgtggttggccctgatttcttctttggagtctctgaaatgcttcctgtcttctgttcttcatgccccatgcccctgctagcgtattactgttctgtgacttccctgtgacctctgcagtactcctcatcctgcatttggtctccaggtgtcacctttctgccgtgttcctaacactttcattcctgtcttgaaaaaagcgcctgctgcaccataagccctgggatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttctgaggaactgagtgtgtccacgttgggggaacgtcatccttgatacacacgtttttatttgcagaaagaaaatgctatttttggagctagaattttcatgtctgatttatgatgattttcttgagaaccagaactgctggcagaaagggggcacccacacgcctagacagctaatgtcttattagagggcagttttgattcctgatttggagtttaataatctccaaacattccagtccaatgaaagttttatccactttcccatataaaaattcttcccacgagagtgacttgattctcacaatccctttggagtcatgtgtgagtcctacagtgtgaggttcagcattgccatctccaagtgctctccatagggaaacagtttctggtcatgatgagcttccgcttcccatctgatcccatcccggcctggaaacaaagcacgtgtttgaggatggcggtgtttggggacaggacatgagcgttttgtgtggggctgctaggacaggcctggcggggtggggggtgtctaagtcagtttacttggttcacaggttcggaggcccacccacatacctagaattcgcctccaggatgggaccagaaatctggttttgcatagaaatggctagcagcaggcaccatgccgctgtccactctgtgcctgcgtctgccccagcacttggcacagcaggacagaagcagagatctgaacccacatctccctggctgctcagtcaactcactcttcacaaagcttagaaagtggccgggcacagccagactctgtctcaaaaaaaaaaaaaggttggttgaggcttatactatgtgtgctgcttggcactgtttttttcacttaaaagatattgcaggttttttttcacgtaagtatctgaagaaagacttcctttttttt

SEQ ID NO: 525 - DNA, 276 bp, Homo sapiens
agcctcctgtgcgaggttgtgtgggactctgtcatggaacccagtatgccttcatgtgctggcttgtttgttgactctgtagttaatgggctgccccacgtggacaggcactgggtcatccatgtctctgtgtacaggcagaggctgctgcgggtacatctgtgcacatggctgccaggaggggctgtgctcagggggagctggggcagaggctggtggcaatggggggcttgggtgtagtgtggaggcacgagagccaggtggccgggctgcagt

SEQ ID NO: 526 - DNA, 158 bp, Homo sapiens
ctacggggccagtttcccttctctatagtcaccctgctcgtcttccatcaactgggtgctcaggacagtggcgtggtggatccgcctgtacagcctgtgctccagcgtcctgcagtccacagctgtgtccagccctgaccccgactgccgctctcgcc

SEQ ID NO: 527 - DNA, 1768 bp, Homo sapiens
tagggctgctgggctcagaccctccctccctgtgctgaggtgtcctcctcctgcctcaagccccccacgccccgagcccaccctgctcaccggcctctgcccgagttccccgcatagtgtgggagtgtggagcatcctagcttttccccagcgcccagttctttcacttccactggagtcctgcagggacagctcgggcaccatgtaggcccgggtgggcgtgggggttcacctagctcggtggtgaacagctggcatgtctctgggttgcggacggtaaaggccacgtagacctcaggagcccgcttgtgctcccggcaggcagccagcctctgcaggaccccgaccagcgacacgatggcttctgggcaatacagcacgtctacggtgaaagtttcaggttactgaaagggacaagtggaaagttccagttcatgctgacctcagcagcagggcgaggccagagaggcagcggtcatatgagactattagatgccatttgaccatttgggccattagatggaaaggcaattatttgggtgaaaaaggagaacccttattagagaaagctgcaaaagaccgaagcaaaagaaaaaaatctccagactcactggtgtccttaaaaaaccagctctggttctcggcctgtctagagggctttcaatgacagaaagcctgaccctgccgtgaacttcgtgtttcaggtgtctgccgattggtctgctggcttgcaggggtgggcctgtgtccctggccaccgctggacctgtgggtttcagggctgggacccaggactacaggcagagttctgttccaccagagaggggactgagtgtgctcacaggggtgaggggttttcggtggcccagccaaacagcaccttctctcaagggccctgacctcgtaccagaagtggttgttttcctcctgcggtctctgaaggacacagggcatggctctgggacagagccatgtggtgacgactgtaacgggagtatgcctgtctccaacaacagggctgtggcttgaaggtcaccttaagaggcacccctgtcctttgatgtcaccctggaggcccagagtaactcttctggaagccccatcacgtccatgcccgacagtgtccattgttcccttttcccagagccaagagctgggtagagctgcaaggacaccgcctgcacaggatgcccggggctgggcattacctgctgcaatgacaacatctggctggaaggcagagagctgatggaccattgctacgtcccagtccagctgggccactgtcaccctggggctgtctaagttgccagtgatgtctgcctctaatgagaggccattgagaaggacattccctcggagctgctcgaggatccggctgtgagggtcgctgaagatgtatgcccgggggcggcacatcttgcagatggcaaggcctgtgaggccggcaccactgccaagctctaggacagtcctggcgggaggaaaggggaccgtgttttcgactgcaccagggtaagcctgcctcggtgccctgccctgtgccccaaggtcacctgttaatgaaggctgccgggttctcgatggcccattctgcaaggtagagggcggcatcccatgtgaccaggcctgtggtaccgtgggagatgatggctgtgctcttggagagtgtgactgagcctcctgaggactgcaccaagagagggcgagagagtcagtccagcgatcagaaggcaagtggcttagaagacaagtagccatccaccac

SEQ ID NO: 528 - DNA, 233 bp, Homo sapiens
aggaagggtatctgggctgtgagggggaggagggtgcctttctcataccagcaaatagctccggtggccctgggtggactccttggccatcagagtctccgcgagcacctcgtacagtttgtccaaaggctccgtgtggacagcctcgtgctgggggcagacagagtgagagcttgtttgctttcgttctaatctgtaaaaatggccagatgattttcaccaagtttggaggg

SEQ ID NO: 529 - DNA, 529 bp, Homo sapiens
ttattccacttggtagggaaacctggatgggagggccttcaacaagaggtgttgagagggtagggttaggtgtagtctagggcaggagacaaggattccgtgagagctgccacatgaccatgacagagagctctgtgtttggatcaaacacagagaggaggaaaacaaaaggtgcttttaagtgagcccaggcagaactgtgagggcggcccatgctgcaggctgtggctgtcagcaggctgcttctccacagctggcccagtcctaggattcacagggcagcagcagggtacactgggtgactgctgccctctcgtggtggcacagggcagacctgctggtgaccagagatgcacccttttggggagaactagggagaaagcaggtattggagaagcaggggattgtttatttgttaaaagtgtggccctttcactcagcaggtctgctactgcctactaaggaatggcctctcgacatcctcatgtcaaaccctgcatgttcgggcccatctttaaaatccatccta

SEQ ID NO: 530 - DNA, 589 bp, Homo sapiens
tgtgcagcacgccggtggctatgctgtccagctactgggcggacactgcctataactgacctttttgatgagttctgagagaaagcaccaggcatacttgactgacggcgggtgcttcacacacacaggatgcctcacagtctacggcaaaggacagaacgttggttgcttgagagcccgtcttaagtctcctatgagcttcaagccaacacagcagagggcaaactccaggctacccgatccctcagcaaagatgcagatggacacagcgttctggccccatgcatctgaagtttgtcttaagatataagccgtttcctaaaaatgcttccactgcagtggcacaggctatggcagcatttctaatgcccattctgagcaggaacacagggcatgtgggcccaaaccacctccctcccaggggagccagtgtgaaccagggtttgcagtaaggtcagtcgccaactatctggctttatggaagaggcgggaaggcccactcagcaactgctctctgggagcgtgtgtccctggggacaggatggaggggaggggaagctcagggtgactccaactaaagctgagagaa

SEQ ID NO: 531 - DNA, 89 bp, Homo sapiens
cagcgcctgctggctgggagggatgcagattctgcccaagggcagcaaagtaccccaggcaatacacaggctcttcatgctggtgctgg

SEQ ID NO: 532 - DNA, 215 bp, Homo sapiens
gtacaaccagccttgtgctgggttttaaagcagctctccctacatctcatgcttcaccacctatgagagtgaggctcagggtgaaactcagagcaaggtgcgagataacttcaggtatctccatgctcgaagccctgacctactgtattgccccgaaagtcttccctgctgtgctgcatcttttccacgtggataatcttggttcatctctagca

SEQ ID NO: 533 - DNA, 1076 bp, Homo sapiens
cctttgaaggtgaagacccaggatgcagggtgatctgcacttggccctcaatgccaaggtcagcctgtggctgggccaggtggtgatcctggctctcacttgcatgcagatgcacttgagtccaaaccccaccctgggcaaagcaagggcccatttaggtctagaagagacaggagtgggcgggacaggcctcatgaatgcaaaaaagaaagtctctgagcatctaccaaatgctagaagctgttttgcacctgtcatctctgtttttgctgtggatggtttaaaaaacattccctagatttcccccctcttgcagaattttgtatattctgatgtcttttctaagtcttacatagaaaacgaaaccgtaggagctgtcggaggtgctgacacccttctgaagtgctgactcaatggttttgttctttgaagagggctgtttttaaagggtacaagcacacctgtgctgcttctctcaggtcttccggagagattcaggaggcaggatcatgagtcccagggactctgggattcttaccttctgcaaaatatcccgcagcagctcagaatctgatgagtctcttaactttgcctctaagctctgtgtggatgggagagagagaaatctcaagggcccattcacaggaacattaaacacgcaatagaatgtgttggcaaagctctatgtgatccctccctggggacgtggagccagttggaagtggaagccacagcggctgaaagcctgaccttcagatgtcgcagggtgcacctggatgagtcacaggaagaaggctgactcttggtcgcattagtcctggctactcagctgccacccaggtcatgggccagctccctggttacactggtcagccaggaattaccagggcagccatggcaccaaggtttgatgggcttgccatctgagtttaagtggaaatgcagaatgtgcccataccagcctgggttacattgtcctcttacaggggcctcaagcccagcagtgagctttggctcccgagttaggcagactgtctcggctggtatgtgacacatggcaaggcacttcattgctt

SEQ ID NO: 534 - DNA, 164 bp, Homo sapiens
taaagccactctcatctggtcttttcttgtttattcatttattctctggctctcccatgcaagcagagcctcatctatcatgggtactgccgatccatggtgcctggctcacggaaggcatttattaaacattttgagactgaagaaaacactagctaacaccg

SEQ ID NO: 535 - DNA, 1091 bp, Homo sapiens
tcaccctaatcaaacaatccctctggtcaaatgtgagtgataataatagtacccacctggtgggtgttgagggtgagcccaagttagcattcagtgtgggcatgtgaacaattatagtcaatattgaatggagacctatgatgcttttatgaaggtttctattttgggttaaaaatgcacacatttctcctgaccagaaatgatctctgagtgctaaatattttatgtcaatggaataatgcaaatgattaagcaacaccccataaaatggggcagacccagggaggaatatatatcccaactgactcatccagtgagctcaatgcacatgaattacaaatggaacggggtgcattaagcccctctgctggcagaagggaggctgctgcctgccatgtgcctgtgctgagaatggcaggtccccagggagaggagaggccacccccttctctgtctcttccatcacaggcgtgaaagcctcagcgcatgagccgattctgtgcagtgctcgacatacagatgagaacactgaggcacgagggacagcctgtgacctggtcaccacgctcaggaggaggtggttacccgcgggcctgagggcgctgactttttagaatgggcgagtgcagctgtgtcccagtgaccagaacgattactgcctttaaaaagtcgtgaaaatgatcgtgaaccgtaccccacaccgagcgcgcgtctaccccctaaggcggtggagacgcccccagcttccgccgccagctcgcggggcagaaggggtgcgagcgactctggccaggccccagggacggggaccgggtctcgcggccctgaccgaggagagcccaggaactcacgtggccggagcgccgggggtttcagcacggagacccatcccgtctgcccctggactcccgcgacccccgcgggcctctccgctcgccccgccgcccacctgccaggggaaggagcgcagtgtgcgcaccgccaggaagcggcgctcaaaaccctgcagcaagagttcggtccccgcgttctcctcgggcgccataacgtgggcgaggccgcagccgttgccgggagacctggaggaagcc

SEQ ID NO: 536 - DNA, 989 bp, Homo sapiens
ccaagataagcgacatcggggcaggtcctgggtagagtccaggttggcggttcctggggcagggccaggatagggcgatcctggaagctgggcttcggaagcgtccaggttggtggcgtcctggaggcgatgccttgcgtgggggcaggataagagtcctggaggcgggcattagggcgcggataaacgccattggattcaggaggcgggacccagagcagagcccaggagacaggtcttagggcggggctaaggccaggcccagagaagggctcaggaggcggggcaggggcggggcgttgactatgtcgtagcacatggccaggcggtgcgcggactctgggaggcgaagcttaggacgggcccacttggggaggggcccagggcccgggaggcggggccgagtccgggctgggctgcgctcaggaggcgggccctgggaggcggagcttagggaggggccggtgttgggagggacccagggactgggaggccggttggggctgggctcaggggccgagacctagctgggcttggggcggggccgagacggagcgaggggtccagggtgtgggaaacggggaggggtttgaggaggggatcggaatgtggctcaagttcgggaggcgttacctgcggagggtttgaggcaggcccaagagcgagcccatggtcttccgacgcggggccaggggcgggccccaggatccggagcttcgtgcggggccgagtccaggtttggggcccgggaggcggggccagttagggcgactgtccctgggatcgtcgggtcaggccttgggctaacgtaggcactctcgcagttcctccgccttcaggaaggtcttttcagcaggggccttacgggtgcatgcttcggtcctggaggccttatcctagcctcctctccatcagcgccacccgtctggggcccgaaaggagggagctttccctctgtcccccagcctttggactgtcaccaaacaagc

SEQ ID NO: 537 - DNA, 960 bp, Homo sapiens
ggtgggattgggggtggtggtgatatagacgtggggacagagtggaaaacaacaaaaatataattattttagttcaaagttattgtgtcttgagttgaaaggcagggcagttagcaacacagcttagatttcagtactgcccctgaaatctgaactgtgttcaaagtctaaaacgtttaccttagcaaattcctcatcaaactccatttggaagagtcccgagagctaatttgttaagtatacttgcaaaaggtagatgaggagacagataaaatcttattacctctttcagatgagaggcacttgagccctgctcagctatgagaataagagaggggaattaattctaattgaatacacttgttctcttatagctgttgttccccaccagaaccaaatgagcgcaagatctgacaaagaaaaaaaaaggttcatcttttattcctccaaacactttcatttaaatcaagaggatgggatgtggttattgctgtgtttttagacagaatcaacggtttctgggtctgagatgttgcatacaccttctcagtccctgtatcctgagatggagtcacctgagaatccacagcaagtcctaaccagggatgggtctgggtgattaaggaaggttggcttcagaactgggccaggggcactgctttgcttttgctgttttgatcagctctctgcctgaaggagacaagaaaaaccaacgggaacaggttagttatactgataaatcctgggcttattttattaactcacataatagctattgtctttcctccaaggagcaaaagggcatatacggtcaatgccatagtaagtaacactgtattatgttatactaaaatattaataaatctaggttggttcagtctttcctgagtccacagattggaagcagattgaggaaggacgctagtggaccacagagctgagccatgcacacagaagaaa

SEQ ID NO: 538 - DNA, 94 bp, Homo sapiens
agaagaaatctttatcttggtgtgcagtgtctggtgagggacaaatgtcatctctcttggatctgaatctggaaggatcaaggcactgaaggga

SEQ ID NO: 539 - DNA, 147 bp, Homo sapiens
tcactgaagggatttttttaatgtcacgtggctctcacaggtgcggtgtgtttgggtgcaagtgaagattacgactgatgcttaaaaacaaatgtaaaattccaggtggtgttgctatggggagcagcattaggacaatctgagtgg

SEQ ID NO: 540 - DNA, 414 bp, Homo sapiens
gtcaggctcaagctgtcacattgcctcacggagtctgagaaggtaataagagtcagaattggccaggaattgtagctcatagttgtaataccagcactttgggaggccaaggtagaaggattgctggaatccaggggtttgaggttgcagtaggccattattgtgcccttgcattcctccctgggcaacacagtgagatccagacaaaaaaaaaaaaaaaaagtcataatcttagcagtgcatcaggaatttagagagtccagaaagattggcttggaagcaggtgctgtttggaaagatggagtaagcaagggatttagtacaaatagtcaatttagactagaagcaatgacacattgagaaggaatgttaggtaagccaaatctggttatttcccattcaatcaaatctttt

SEQ ID NO: 541 - DNA, 643 bp, Homo sapiens
gaattattatatatgaagatccccagtatatcagtatttagaaaggaccatgtgttctaatcacgtcaaattatttctttagattgaaggtcatacaagcagaatattcaaccttctctgtttcaactggagacagactttgtctgcaaatccacaatgatacagtggagtcaacagtagaatagatcttggctggcttggctgactagaagttcatcaaaatgggtttgccacttagacagtaaacaatagctgtgttatcttggtattagtcaaatgagtaggaccatggttattgcttccaatatgcaatacccacaattccctcttcactaaccaccccactgaccccttgttctatttacctaaccgctttccagaaagtatggttcagacatttggttaaaatgtaattttgaatgttcagacttaaatctacacagaatcataatattctgttctgcaaggtttttattagcatggtatcattattaggtattattctattcctgactagtattgctaaatggtttaaatacatttaatttatttttgtttattttagtctatcttaagtgctcttaaatgcatttgcttgtagcatttttaaagttttggcttgaagttataaccaaagaaacac

SEQ ID NO: 542 - DNA, 638 bp, Homo sapiens
ccaagggtagggacagttctagtacaaatccatgtgcattaagagatacggataagttcattaccaaggtctcttaatctgtttaaagagagataattgtaacattccttgatgataaggattatgaagcctatttaaacattcccaatatggtgagagatgtgaaaaaatgtacctctattgagatctatttctgacaataatgtttttctagagtggtgcagtgcatccccctacctgtctagtctcccattccagaaagatggagattcccaggcatttctggcttggcaggctatggactgggtgtgttctgagcaggtgccaaggcagtgcgtttcttgtccttggaggggaaggctgaagccgacgggccactgttgaataccatcaagggaagtaacagacaagttataagcaaacagttcatgccttggtggctaagtcaataggagctactagaggaatggttgctagcacagaatcaaaggaagtagagaccaaggtgagagaggaatttggaggtaggtagagagatgagtctggaataatttcagtgtgagaatgcagatgatcatggaagcattttatgtaatagtggcagcctctgctttggactctccaggtgtataaaaaac

SEQ ID NO: 543 - DNA, 267 bp, Homo sapiens
cttgattcattgaaaaccactgatccaaaaaataaaacgtttaacatataccacttatcaattctgtccattctttagtaaacatgcagatatttttcatggcttcttgtagaagataggcaataaataaggtcagtacattctgctgaactgatgcacctgaggtcactgcaatggtgcaaagaactgctgctttggttcatttaatattaatgacccctgatttgatgaattctcagaatgtgaactccttaacgacagggactc

SEQ ID NO: 544 - DNA, 182 bp, Homo sapiens
ggttcaatagttttttttttttttttatccatgtgatcgcctacccccaatatctgtagggtctggtacctataatattcttagcaagaactatgtgaattatgattatcaatgaacaatgaagttacaaagagaagtgaaagtaacacttattaggtacctcccagttaccaggtgtttag

SEQ ID NO: 545 - DNA, 237 bp, Homo sapiens
tactgcaaacagaagtacagttcataaccacaggaaaccttgagtgatctctccatgatgagattgatataaagtttgattcaattcactttgttaggtaccaaggaaatagaagttcatggctccttcctaccctcacagagttagtaagctcacatatatttcaatcatttgtggaaaggttaccacgtagggggcccaggccttaaaataaaagccataatttatcattcattc

SEQ ID NO: 546 - DNA, 62 bp, Homo sapiens
tgtcactcttacagtatgtctgaaggccctgatatttcaggacagaaagaaatttgtaagtg

SEQ ID NO: 547 - DNA, 259 bp, Homo sapiens
aagtgttaaatttaatcatttaaattaaatgcacaaacatggagacttccttctctgctcagactgacattgtgagctattaagggggaatatttgagccagcttcatggatggcttacagagtagatacactgaattgcagatactgttagaaagagctaaaaggctctctctatcactaggaaactgagcacctgggacctgcctttctcaggtgcagttagatatgctgcttctgtgccgtgtccctgaaaacagt

SEQ ID NO: 548 - DNA, 40 bp, Homo sapiens
tcattttaccatcgaggtccaggtgtgtgaaccctctccc

SEQ ID NO: 549 - DNA, 498 bp, Homo sapiens
gccaatgtaatggatatgcattgatattctgtcctgcatccatcctttgcctcattctaccctatgaaaatcatatcacaatttcgttctgatggtcccacctcaccctctcagctcttgtactttaaatgaagttgtctatcctttccctccaggtgcaacagtgacaaatgccaggttttctctaatcagcacaaatcagcacattctatacctcaggctttgctgattggcttaaagctgggaatatttgagccagcttcatggatggcttacagagtagataaattgcactgcagatggactataggaaagagctaatgacctaagtcaggccaatcagaaccaaaacaatctaatcatggtgtatcttttcttagctaaagaaataaatagattatattcactgctggagcgggtgctacattttgtgagtttgaaccaatgaaagtcaccatcacgaccctaaaaattgagcctatctaaaagatgcagctt

SEQ ID NO: 550 - DNA, 673 bp, Homo sapiens
acttgcaagtataagagtttaaagtgatcaaactgtcttaaagggttgtattgaggatgaaattaataatgatcaacagcactaatccagaggaggtgctcactaaatagaagcaattattgcaatttcattttcagcttcctttaaatactatactctttccatgataacgattgcagtggtctcaaaaatggaaagctataatgggacttaagcagaaccaggtgctgcgaatttgtgtatacttttaaaagttcaatgcatcaagccaagaagactagttactctaaaacagactattcttcatcagaagtacatacctgaaaagcacacacaaacacacacaaatacatagaagactctatataaacattcaccctcgtatccaacgaatatgtaagtctccctaagttgaaaagaggaaagaacaaaacttgacatatcctatccgattaattcagtggagtgtccaaagcagattatgttaattccaacagtaattcttaatatttgtaatgtaatatatgacttgataagattgtgaaaccttctgacagcttattagctgatgccattaaaaccaaatgtcaactttatcaactgctgtcagtgatattagcaatgaaacagtctccaagggatggaggttcaatttgtgttggataatggtatg

SEQ ID NO: 551 - DNA, 398 bp, Homo sapiens
acgaagtttaatgttcttctgtggtttgtggtcactttacagctttgagttcatgaagccagtgcttacaatagactttacatccccccaattgctttgcttgagttaggatataatgccactgggtgtggaaagatgcccacatagaagagaataataatagaaaacagataatggaatgcttttccacttcattataccacaaacctaaactatattattaagaacatttactcacaaagattaactaattgccatgtttgtaaacataaatgaaaaattagaatacatttcaaagcaatgaaaagcagggatatagacaattgaagttgaaagacacttagacaaaatagcgctccatgctctcatttaggctttatgaatcttggcgatcattt

SEQ ID NO: 552 - DNA, 39 bp, Homo sapiens
gtgtgtgaaccctctccctttttaaattaatctatttaa

SEQ ID NO: 553 - DNA, 144 bp, Homo sapiens
accctccctcttttatatgagtcgcagtaatttggcttttactatttgctaatcaaagagatcttatgcaggtgctgactgctaaatctttagtgttactgataccagttaacctaaagtcacttttctccatggtaaatacgt

SEQ ID NO: 554 - DNA, 874 bp, Homo sapiens
ggcataaataacttgctggatttctgagtgttaatacataagaccctagaattttaggaacttcatacaattttaaatctctgcagccatggactagtccctggacacagaaagtgccttaataagtgtcattgtcctgtgttgtctagctgtcaacatcactaatccttgactctttctttggctactgagttatacgatttgtcactgactgttctttgcattctccctccctaaccacttaatttcttcttagcaaagtgaaaaggagtctctttgtatccccacatgtcagcaaaaatgagaagtgaagtaattctatagcagcattttcacactggactcagcatggaatccgtgattattttttccaaaataggaagtaccaattttcttcttttcaacaagagaatcttttctacccttgggtatttgtctaaaatgtgatgcagtgctgcagtttgctcatatactaggaggcagttcccttccaattatatattatgaattctatcttagatgggaaaaagccttgtggcagttacaaatcccaagctaattatggcataactttaagaggcatttaaacattgaatcggattaaaagtagctagcaaatgtggaatttgtaaagaatctatgcaatatttggccatttcctaaagagacaggagactcagatgaggactaagcaggacacgatttttcatcaaattaactaaattagtgctttgtggattgcatgtggcaactagtcagtaattaccatgatctgcaaatgaaaacttatttgaagatggaaaataaagaaaagaaatatgaaatctttttttcttttttttttccggtcagctttggcagagactagtttcca

SEQ ID NO: 555 - DNA, 203 bp, Homo sapiens
acaatgcaatctggatagaagtggtgtgcaccattttagggcctgaccatgcaaccccttgcctaatctctcattctgttcaccctccagtggtcatggtgaaggtcagatattgaaaatggtggcatcacaagctgaaaggagatgagatcactgtatcattttttaggcgagagctacccaggagagccacagatcttcat

SEQ ID NO: 556 - DNA, 2847 bp, Homo sapiens
tatttttactcttttacagctatttatattctttcatagatttttcctctaatattaaatacatcagagcaaacagaaacaagctcaactattttacagcaattactaccttggattttagtgacatgggaatactaacaaaggacatttaaatctgagtaagatgtcagagaagtcttccaagataaggtgaaaaagtaaaaagtagaaggcaaacagaaaaggcacagcatgcagagaggacagtaggcaggaggacatgcaggcaggagcagcacaaggacaagatttgaggaactgccccttaacccaggtgaaaaaagaatacattgtttctcaaagccagaacccccagtgaactgcctacgccagaaggtcctgagcctccctctgcccatcccctgaaatactgtttgatttgttacagagaaaaatgagcctcctgtctgaaagagggaaatgaggaagagcagattgctgagtctgaggtttgtgctgcctatgtgctgttgaagagtcacctggaagcagatgctgtggggaagggaacagctggactcatcaacatcatggttttcttcttctagctcctgattgatctctacaattttattcagttgtatgattcctttatataattcaacaagacctacattgcatagaagattgttttcccaaagtggagaggatcttcacagagaaaaagagaaggcagtttatttttcagctctgatgaaacactaaagtgtgcggaagagagattgtttgttgaccatccctcatacagcatgcacattactcactgaaagtggaaaccaacctgtattgcttataaagtgtgaaagcacaagcttataaatgtataaaatcttttctgggtgtgacacacctgtgtccaattttgaatttttatgatatgtgccacttaattactggcactgagtatcactgaactttttagttttctagtggggaaatgttatggagaagccctcccttattttaagtaagttaattaaatcttatgtgagttgtcaagtgtaatttttcaagggaaaaattttgatgggtggagaaatgaactgccagataatctttctggaattccgggagaattccaaagaggattttttttttgacacttttttatatctttaaaagaaccactgtcaagtaattcttagaagaatatcctgggaaatgaagcaagttttttcccgtgtgtaagcaatacacgaagttacatttgccctaaccgtagggatgattctttacccagttttaaagaccatagtggttttctaaggtgttgacaccctccatcctcagaacaggtagaaagtattaggagtgcaggaaatagactagggactatattatggacagcctgtgctttttgacttcagtttgctatctttctgtgatcacatcagattactgattcatagattctatcttttataattctggagaaaaagaggtttgttagttttgtaatttttcgtaagaacaaatgtatgtattttaggagctccactgcatgagaacagtgtaactcacactgacttgtgaaatcaggcttctctaggccatgcgtgtggagaactttctattttaccaagtgggagggctaaaagcacagcagcctttttggtagtcacatggcggaatgatcaaagttacattgcttattccaacatattcgttctttttaaaacttttttttcacccaaagaaaagaataatataaattattaacaataaacataaattccgaattttgatgtgggattaaatatccagattttatttttaatcttaatccttagcttcttgggagttgctgggcttcagtgtctctgtggtttcgccagcttggctaagctctggttattttggatcttttctgcttttttaagtaacagagtcatttttaccaaacaatatagtttgaatgtatagctgggaaaacgtgtattgctctagattggccaatttaagccattttaaagaaagttagttcatagttgttgccttttaactcatagtcaagcttcattctttcaacgagaaacttgtgatttacatttacttgctaatattttgtagtttggagatccttgtgggcattattctaactaatatgtagacacttacatggaaatttttggacataatattaaatgagtggtatctgtgaaattggttgtattaggtggcttgactaatttttttctataattgcatatgggctgcattaaaaaaaaccctgcattttcctttatgctggattgtaaacaattatattacaatgtataagacatgtttttccctcatatgttagacttttcttagtatttcatatttatgtgtagtcattttgtgatttttaaaccagaatttggtttaaaaaatatggttataatatatgtgtgaaatagtttggtgtttaccttatgaaaataaaggattgtaggtaaggtttcctgtgcaccttataccagaattcagtataatacactactttctgttttcaaacagataaatcataatatagtctgaattgtctgtaagatctatctcagaaaccacattcttgacaactatttacttttgaatagtttgcattttaatatgtgacttttgccttgaaaagtagtaaagccataaacttgtgcaaaacaaatttcaagtttatagatgttaagtatctaatgtaagaatcaaatgtgtatgcaaaaatacttttaccaatctggaacttgagaaaaatccaaggaatttgaaacatagattttaatgagctgataaacacaaattacgtcaataagggtagtcaggatatta

SEQ ID NO: 557 - DNA, 29 bp, Homo sapiens
tacattgtttctttccttatattggaatg

SEQ ID NO: 558 - DNA, 38 bp, Homo sapiens
caatttaaaaacagaaggctaatacgtggtaaatccag

SEQ ID NO: 559 - DNA, 202 bp, Homo sapiens
tctgggactcctgaaacatgtagagtgggcactgagggaagtgcaacagagtgacaaatgtccttatgccacattaagatgaacaattaacaacagagctgagtgcttcctgttatttttacccactattgcactgacatcttccagcaaaatgttaatatcttatttatcaaataaaggaaatagtacaaacatttctggg

SEQ ID NO: 560 - DNA, 1316 bp, Homo sapiens
gactctaacctggttgtaagatagccattaactattcctaagctgcaatcttaacagaagagcctgaaaaaaaatgaactgcttttcctgggagtaggaattaccaagaaatactgtgtatcagtagtaaagatcctaggagcctttctgttaatggtacactaagcacccatttcatcacaaattttctaggtgtaggtacaggccttgactttatcacatattagccttctgctttttcatttctctgttttctcatcagcaaaagggatacatatacagtctttagatgtctctgtttttgtcatttattgtagaccattttcacttcttaaatactttaaaatttaataagagcaacacaaatgcctgaccttgacaaacatttgaaaagcaaacatcaatgagaaacatataaaactctttagtggactctcaggagttttcctaagtgaatcagaggaatctgagaaggggacatctagctgaccattagcacacactctgaaaagagtcacagatgtgatgctttataaggtagatttgcatttgttaaaggtcattctccactgagtatttgcacttatgtctaagacacaggaaggccactctacctcgttcttccaatttgtctgttccgtgatcaatattggagtctagactaggacgactacaggatcttaccactgcttgatttcccataagattgagcggacttcctgaaacaactggggtgggcaccaagggaagtgcattggagtgacaaatgtccttatgccacattaagatgcacaattaaaggagctgagtgcttcctgttatttttacacactattctactgggatcttccagcaaaatgtttatatcttatttaccaaataaaggaaatactacaagattgagtcacagttctccacatttgaagaaagttaaagatgtttttgacatttcacattctgtctagtaatggactgaaagtgtcctgtttctgccaggctccttacaactaatgaagactcttgtctttcatccgaaagctctgctcaatctcaggctttagcaccaatgttatggctgttcaagggattttaaaaagccccagattagtcattctggggatacagaaccaactttctcttgcttcacccttacttttgtcttcagtcccagtgactgggcctctgccttgactgagattaagctctaatttacattttggttgtaggtacctagctcccctttctccccctgcatcataatccttgtgtcttccgcgactagttccttggggccccagttctagctacatgtgaat

SEQ ID NO: 561 - DNA, 224 bp, Homo sapiens
tgatctgattcagttggccaaattccctgggtcttgaccttggggtcacataactagaaaacaggaatggttacatttaaatccagattaatttgtgtttcacttccagctccatcattttcaaacagtgtttaactagagtaacttatttgcctctgttgtgaaatagagtttcacagttttggctactgaaaggagtaataaagttgaactatgttgactta

SEQ ID NO: 562 - DNA, 95 bp, Homo sapiens
atctataattaacaatagtacatcagagttacccatgttttaaactctttgacattttcacgcggttaaatatcttaaactcattttacatcatc

SEQ ID NO: 563 - DNA, 68 bp, Homo sapiens
aggtgaatattttctgaagatgtcacttagtaaaattgctgatagggttgttgcttatgatttgccac

SEQ ID NO: 564 - DNA, 685 bp, Homo sapiens
cctgtcatatactgtgtccaaggcgaccctacagttacagtcctccatacttcatgatcccagggtactttgatttttgctgctgtcattttaatacaaagccaccttcacacttgctgatgcagaggaagaacatgctggagggtcttaagttagattttaattgggatgataggaagaacatctaacacttctctccagaaccactgagaaggatagtcacatggccctgcccagctataaggggaatgagaaagtataattcttacatgttcatagaaatggaacaaaactgaatatgaagaagtattagatatctctaccatgagtgctttaacctaatttgtacaaatttcccctttggattagtgggataaatggctaaaaaattaagccattacagtgccttcagtggtaatttgggattggggaaggcacctggcacattgaccctggaaaggatatatggggacaaagctttattcagtaatgggtacacagagtgataccaaagttggatgatgtgctaaaggaaataaataacatttcaccatatggcagctgtctgaaggctgttttgcaggaggctggtcctgagcttttctatattaaattaagacacagtatatttgatcaaaaggtttttgttcttgatatcacttgagctgggatcaaatattccact

SEQ ID NO: 565 - DNA, 389 bp, Homo sapiens
aataattatcaaggaaaatagaaatgaatccagagtaaaagagatgatcatagtgatccccttttgagtattcacctgagtgtgtctcccttgatttgtattcctagaaggaagaatgtgaagtcctgtgcttaagacatattgactcaatttccaatttgcatattatggattgccaccagcaggcattgagtgaaaatctttattaaaaaatggtgctgttgcagcaggctgtgctttggcagcttttatttccccttttcttgcatatttcagcctcttagcttttagataaggggaaaaaaagtaaatatttcaaataaaaaacctaaaattgctatgttaaaatgcaatgggtggatctcgcttagtttcgatatgcataaacc

SEQ ID NO: 566 - DNA, 596 bp, Homo sapiens
ataaaaagagtactacaaaaattgccatctaagaggatgaagtcatttctggggctgaggagcatatagaatgtgcacttgaaaattgagcactttttgaaacttactataagcagttcatgtcaggaaggggattgctgtgccttactctagagcccattccttttttttttatgagtgcgacagagataaaatccaaacgtgatcactgcagaagtgatgtcttagaaaaatatattcaattctaatccatagatatggaagtggtggaaaaataatgagtaacagacagctggtcctccatcaccaaaaacaatttgaaagtcaagcttttctctgttgtttttttttcctcctttatttcctactctggtcccccaccaatgactcctgaatgctctgacatctgtagacctatttttaaaaaagtatataagtatattcttaagtatgatcaagccacaaatattcctttgtcaggggaatgcagtcaaatggttcatccaaaactgtaaaaaaacataaaagatatagaagtaataaacagagatttaaaaaattagtgataattgattaattcatttatttattggtca

SEQ ID NO: 567 - DNA, 88 bp, Homo sapiens
atgttgcaagcactcaactaggccgtgggatgctaatggtgaactactaatggagattacagtttaatgattgagggatcctacaatt

SEQ ID NO: 568 - DNA, 923 bp, Homo sapiens
gtttgttatcctactcaacagattggtctgaaatttttggtgtaaagattcagatattgaactgtctcattattgcaatatagtagctatcagaaaacccatcctgatttcttcctgtattctctcttaaggtgaggtgggaagggcttggtttttgatatacctgggtttcaaagtggccttaatttttagtggtattttcacattctacactactactcttactattagagaaatgcagtttgagcagaaggaaatgctctaaaacaattcccaaagcaaaaagaaactcccctcagttaaattgttttttttcttcttatcatatgctatgctggggacaaatcaatttagctatttttaagcaaagaacccagtgttcgtcttgtacaaaggaaaaatggtatctcaagtaccagatctgtttctgtgccactaggcaatgaagtgatgagtgtctacaatatttacattaaaattaaaatggcagtttcttttggtattgctggcattgcatgggtgaaatgtgtttctagaagcagctatttgggaaatctttaaattttgcagtttaaggaatacactgaagatcccaggaaagttatgtacggggaataacatttgctagggactgataaaggctatgtgtttgaatccgtatttcactgcggagctaaatttgctctcggcattctgatgctaatgtccaccatggactgacatagtcacgtagagcaaaatgatatttttatactttttccagagctaatagttaatttttcttagtctgtttttttaaaagatgaatcttctttgcctcttagagtaaataataaaaaagggcttaatcagaaatcaagtattttagctttacttaatctagagaatatttaaaattactggatagagtcttgggcttagaa

SEQ ID NO: 569 - DNA, 656 bp, Homo sapiens
ctttttcactaccagatggtgccatgtgagaagagctttccattcagttggttatcatctcttcctttttcctcatccacacccaagttcagctgttttccgatgagaaatgatttaggaagtgaatgttcccacctgaaaccaacagaaagtacaggaagagccttgctttctgttttgagatggttctgcaaccatgaacctatatgaccatgtcctgcattagcctcatgtccgtgttgaatcctgaatgatgacaaagtggtaactcactacacagggtccaggaaagcatttgttgcactccaaatcctttggaaattcccaactgaaaaacaacaagggctacagaaaagggactcatctacccatgaagagttagcaggtgaatcagtgacaccagaagttgttgattgatatagaccatctttgggcaaacagaagtaaacttcacaagagtcttagattctatgttttttaccatgtcttggagtagatttcaagttaaactccataggtgatcatgtgacattactgaatagataaaaacgcatacaaaatattaatgtatagaaaaaagagacttttaattttacctgccataaattatgcttctttttctaccgtgaactaatgtctacattctatttctttac

SEQ ID NO: 570 - DNA, 323 bp, Homo sapiens
agaaaatgttaatatatagaaaaaaatagacttctttttatttttttcctgctatgaattgtacttctttttctattatgaattaacatctacattctatttcttactggtctgttgtcaaaagttctgttcctccccaccccccattcattctggcgtagagtttttgaatggtaataatggcagatatcatgctcttgccttggactagtggcccataggccaaatatttctcagcctaacacttatctcagggtgactcggcttttccacactctattgtttggaaaacctacataggaaaatgaaaatactttacactt

SEQ ID NO: 571 - DNA, 199 bp, Homo sapiens
tgtaatcttgctggagttgatgttcaggccttgtgatggagaaaggcgctgttttccaagagtttaaattagacattgctgttcagtttctagattgttcatagattaaaaaaaacctcagccacttattagctaaatcagctgtcatgataaagttcagtagtcaccttatccctttgtgccacattgtcttgggagc

SEQ ID NO: 572 - DNA, 25 bp, Homo sapiens
gattacaacaacgacagcagaaaat

SEQ ID NO: 573 - DNA, 234 bp, Homo sapiens
agctcctgctgttactgttattgacaattctaagggtgagacaattaaatacattatgtgaaaggctgtcagacaattttaaaacagtggaatcatcagtttttcaaccatctatatcactgggtgattttgttaatttgagggctaattcatagtacctaatagagcagctttttaagaaacacaaaaggcattgggcatgatctaacttctagctggagtagagatagcact

SEQ ID NO: 574 - DNA, 415 bp, Homo sapiens
tattgatttgaatttgataatatgtcaagtatctgtcatgccatctgtatgaatatctttgtggtgtgacaaaagaaaagccccaatcaccttccttgatgtttagatgatttaacatgtgagtgtgagtgtcaaacaatcatgaagtagattcatctgtttaatagagtggttgtaccactgagtcgtgtaaagacagacttttttttttattactaggaatcctttaaattgaattgacagtgttgaagatttggaagtctttgtttatttacttatatagcttccccaagtaagatgcaaattaaatgcaggcgattgagttatagaaaaaaattcgtaatcacaatctcatttttggttctgatgttttacaatgaatggaacagaatgtgggagaaataattgacaccca

SEQ ID NO: 575 - DNA, 312 bp, Homo sapiens
atattagcattgaaaagactgtagtgagaagttctacttcctgatttagtggtgacctctccctaatactcatttcacaaatgactttctcactcccatccctaaagtttacatatgttttatccagcaatagcactatatacaaatcctgacttttcttaaaaacattttgaacatgagattctctgtcttgggagatggattttttgaattcatttgctctgcatcctggcattctggttacattgtgagaagcagctgtattctatgttagcgtgatttgaaaattttctttgtaaaggaccagtcaca

SEQ ID NO: 576 - DNA, 1011 bp, Homo sapiens
agagatggagagaggtgtataataagagacagagatgggatgatggaaacagatatagacagatacggataatgagagcaagaaagcaggtgtgatggggatcagagatacagaaggaaagaaaccaagaaggcagagtcccaactcctcctgggcccagcagggagctggcaagaaagcatctgaagccagagggacatattatctagaaccaggagttgaacctaattgtaagcagaccctgcccaccaccttcagatgagtgatggactcctggcatgtgacctggcttggcaatctccaccccctatccgggctgccataaggagatacgtaatgtctggagtgatgggaaagtcatgcttgcagatggtacagatggagctacctcataaaatgactcactgtgaatcctcactgaaatctccgctataaaaatgataatggaaaaagcacaagaaagcctaaatgggcttgaaagaaatttgttccaacctgtgtatctcccttcaaattttgaaaaagaccctattagaaagtgccaggaagataatgtatcttcttccctcctggctagagccctcccccacccccacatctttttggacatcagcatgtgagtgaaaatgacaagggaaaagaggaaaggtattggaggaagacgcacaaattatttatgcagcacgagggctgatgttctggagagggagggctgggaggctcttttggaagaaagggagtggtatcttggggagacaggaggcaggctgtcagggagtgggagaaattgtattttgcctggtgtctggggtaggatgttgccagagtggagggggcctccctgagagtgaggtcagacactggatgagggaggcaaatagcagcatgagtcatgcagacctctgtagcaagatgaggaaggttttaagtccaaagagcctagaattctaaaagtaatgattatcagctctttcaaagtcacccaagaccatgacacatctacatatgatc

SEQ ID NO: 577 - DNA, 1632 bp, Homo sapiens
gagcagtagtgatttcatttaagtgaataaactgggggaaatgattgccttttaaacatgcagactatattgcacggagaaagcctgctcacataaatataattttctttaaaaaggcagaggaagcttctgttaattgaactactttctcaatttcctattgccttcagaattggttatggacatgatttccattgtctccaatcacaatagcttctaataacattaagcttaaaataatacagaagaacaggacagacttgtggtttgttcatttgctgaaactaatatagatggcagaaattttacccaagcttaaaatagcataaaatagcatatagaacacaaaagtcaacactggctcaatgatgaatgaaatttcattataaagaatcacaacctaacatctaattttagtaaaaattttggaactagttattgccacaaacaaatgctggggcagaagataataaaactgtttactttatcaatagattaatgaagaggagtaggtaattctgagataatatcatcccatagtctgtgtgacttgaatagtttcaggtttaatttcatgattcaattggcctgcatatacgtaactcccagaaagattatagatgagtgcaattaatttgtacagtgctaaagcttcccacaggcacataaaacattccctttagttcctttagagttaatattacagattcaggttatttttcatcagaaatgaatcccaaagttgataattccaatcaaattggtaaaaataaaagcatacctacagttgctttgagatcaagaaagagaactgtagattagttctaattttatataggtaactgaagtgaataaatgcctctttctaaaaagataaaaacaaattaaaggcttttgataggagaaactttaatatatctacaatactgtgaaatacatcaggataaattatgtttgctgatgatcattttcattatgaaactcttacaatatagccataatatttcattttgttgaggtagagacagaggccaaaatctatcaatcaaggaatatttattaaatgcctgtgggttccctgctgaagggaatatcgaacaagcgtaagttgtagacactcatctcaaggtacatgcagactgactcatagctaaatgagtgaaaagacaataagcataagagaagtttacaaagagatgtttttttttcgtagcatggtcagaaggtatggattgagctgggctggaatttagataagaagacagatgtgcaggttgaagggatcagaaagtgcttctgagggttgatacactaagtgaagctttgaggtaagctaccacatagtgatggtgtctggctaaaagcagacacagagaatgtgtggaagattttgaacctggacctagagagttttgatatccccagagagggccttcgccatgagctgtctgcaccagtaaaacaacacagacaaggatttcttagtgggacatacctccaggggaacccaggactcagtaccaacctgaacaatgctttcagggtaccctgatggaaagacctggccagaagtaaagagcctcctctgggaatctggtaaagacgttggcaacctgagatatggggggcaca

SEQ ID NO: 578 - DNA, 2534 bp, Homo sapiens
ttaaagatttgcatcaacattcatgacacattttctctgattcattagctgaaatatggtcaccattaaccttcttccactcttccctattaattcatttccatttctcacttctctgccctagacactctctttcctgaaagtttcccctcctcatcccttgtcagtcttctcatgccctcaactcttatgtatgatttgtaggacattatccatttttactcatattctcttttatataaggatgtgtgcctctcagtggcattatcaactctgagagaaaatgaacttttttttttcttttaaaataactatctgagagccccaggaatctcctatacttggaagcaaagagttggggatagaggggaaggagaagaaaactgaaagtttggtgatggtggcagaggaaaacctaagtacaaactgaccccatcccaggtagcctgactgttctctcattctactcttggtgattatttatacaatgtaggtggcaatccagatttctattttatatggattgaattgaataactacaaaataataatgagttaataaaagtattgcattacattttacatatataaaatagcattcaaaaactaaattaaaatacagaggttgagtgagattttatattttctacatcaactactttaattgagtatctaatccataagacttggcacgaataagatctcaatgcaacttttttcaaacctcaggaaacagcttaatttttcccccactgatgacaaatattgttcaattattactaacactggtatgatgggacagaatttggaggaccatgcatatcagacagagaagtcatctgtgaaaggtcatattaagtaggggaaataaagtgatagattttattttttaacaagacatgtttgttttatatataaaaagactattttcatgtttcaatcaactcactgacaaaagcaaaaatataactaggaaggcaaataggcaataatggaacataagtggagtattttaataaaagtgacttcatgaaaatttgtcattttggattatctgcatcagtgatccacctatcaaatgtctcccttcataaatttctgtatcagataattttttctctcttaaagagagctgcagagctaacggagaaccaggcaagataaaaaaaagattgtttatctgctgggcagggcttataaagccatcttgcatttgctacagaggcctaatccaagagcaccgtaattatcatttctgaacctgggtccctcaactggcatttctcctttgacttacaacacctgaaaactaaaggtagcatgccctctttaacaaaagtgagttgaacataatggactctgtgttcccgtatttttaaaattgactgtgttctcaaacattaattcaagcagttgcacaattcaagggatgggattgtgtctccgcatttttgttgttcaactagagatcggcatatctcccagctatgagtatgcataaacagcaactgcaggtaatacttggatggtgtcagaaaggtctcaaagcagaaattttctggaaaagtgcactaaacagattgtttccatttttgctccccccatcctgcaagtggtagctgtttcatggcaaggagcagttgtgggaaggttgttgagggtggttttaaaggaaacagcctgtgtttagactggagtagttgcctggaacccacaaaagtgaacgtttctcctttcacttgcatttgcaatgtgtcacaatggggattgctaaatttcgcccagatgctagtatatgcatgttttaggtatccttgtgggtgagtgcttggcagtcggcatgttgcctttgagagtagagtaaaatgagagaagttcatccggttaaaatctagacattcaaagagcaacaagtatttgttaaagtttttagaatgggagcagataaacgatttggaaacatgaatctttgtggaaaaacaaatccaaattattccaaacatgcttgaacacatcttctttttgagatcatttttctttcttaaattttttactaaaatctttggtcagtgtagatgtgtatcaaaactgcattgtcaagctgagtaatggactattctattcaacgactgttggtcatttttaaggccgtgagcggacttatatgacatactatataaataatttgttaaaatgatatttcataaaataattaggttcaaaggtattaccttggtgaaaaagcaccattagaaagtaatacaaatatcccttttaatgtatcaaaatgtatgtttaaaggaggcaacaggttatcataccattaaaatatttgtgcacaggaatgaagatattgacatttaaagaacatgatggcaaaataatgttttggattttgctagagttttcaagagttttaattgctcatctaaaaactgtaataaaatggcacaatcataaacaataaagaacaaacccaaattttgtattgtaaatggagtgaatggtccaaactgttcattttcagaactacac

SEQ ID NO: 579 - DNA, 894 bp, Homo sapiens
cagtccttgggtcaggtcactgtttgcccagaatttgaccctgcatggtggtgctccaccaattttccttttggattacattgatatatttaagtaggttggggatggtcatgatgctgtagtaatgatagtatagcagtatgagtgacataaggtctttctgtagaatcttcaaaatgctgagaaagacagtcttgtttgtagtgaataaaccaaattagcactgaacacacattaaatgtgggggaaaatggtcccaaagaatttaggattgcagttgtaaaacaaatgcttggtttagcataagatttcagcaatgctttttagtaggcatattgatataatatttttggctttgaaagccaaaactgacagctttatagaattccatccaactttaattttcatttttcaaaagtaataaatgtcttgctgacctaagtacaggtaagtacatgatgatagcattgatatcagtaggctttatcagattggaaaaggggatatagaaaaaaggaggaaaaggacagtatcaggacacatgcaagaagggcatttgaacagttactaagaaagggcaaaacacaaggaacagaaaaaggagaagccaaagagttttcagtgagcttcatgggttcattggagctcaacagctctgcacatatcctgcagtgtataccacgacacaaatctaacatttgcatcttctgtactctgattgtttctgatgggtaagagtctgagctcagaaagccacctaaactggctgggaaaagttccagaagagaaagaaacaagccaatggcaaaattccctttcctcaattatgacagtgaactatttccatcaatatgaatgactagtcataaatattaatgataatggtaaaaatga

SEQ ID NO: 580 - DNA, 245 bp, Homo sapiens
cacttagctgttccccttctttctctggctactcccaattaattagccatgctagtgtatcctaaatcagaaaataaattacttgaaatgagtgtaattgcatcacattattcattgtttcagatgagcatattctctttctagatctcattgctgtccttggtctgactttataatttccttttgttctctaacaaaaatagtcatactaatgattttcatacatataagatgatgaaatcctt

SEQ ID NO: 581 - DNA, 213 bp, Homo sapiens
gtgttccagtcagcctttttctacacaattgcacatacacacacagatatcccatatgcataatctctattcagttatttatgagtctattactgtattatcatatactatgcacatattgacataatattaatctcatttaggcttccaccagagtttctaggtatatgtgtgtttatgacactgtcatgtgacagaaactgttgctactca

SEQ ID NO: 582 - DNA, 441 bp, Homo sapiens
gcaccatagatcataagcttgtaggaaaaaagaaaaataagccttggcaaatctgtccaacacatggtatacggtggttaaaaaatctatttgaattttcaaaatgccatttgaaatctttacaatttcagtcttcaaaatcatcattcgaaggtaatcataatttctatttctgttaagatttttcagaaggttaatagtagtaatgaagggcttaggtgctttattgtttgttttgttgtttagtgaaggcttcacaagtttttgggaagtaaggaaaatgaatttagaatgaagataaaaatcttattttgttcaaattatcttgaataatgaaacatcaaatagtgaaaatctcaccacgtttaggaatccaaatctgttgtgaaacttgcttaaggccacgtaataaataagtggcttagggatctatcttattct

SEQ ID NO: 583 - DNA, 381 bp, Homo sapiens
tagccacatgctattacactaagcaactgactgactcaggaacatattcaaagaaaaggtccatgattggtagaaaaagtgtgaagccaacttttagtcatccattagcatcattatcctgtctttaaagtattaccattcctgctaatgtttatttttccaggttgtatgtcctcctggaggaggtatgcatttggattaaatcaatcactttcaaaagcttcaaatcagtaggtttgacaaaaattttcaacaacaaggatgaatgttgttgcactgtaagtaacaattttgacatgaagtatccccaaactattttgtaaacctccttaaaataaaaacgaataaaaatatttcaatgctacatattaatgaattata

SEQ ID NO: 584 - DNA, 287 bp, Homo sapiens
ctaacaaactgttctgattctctacctttaaaaaattatgggaaatttgattactatttaaaagactactctgtaaagcaatatcctacaagtgaattgcataaagttcatggtaataatggttgacttaaatattgttttatgttccacatatttacatatttatatccctccaatttattttgaaaaatggctcaaggcagtgtctcatagtagatttgtaaagcaagaagtctaaacgtgttcacttacatgtggaatatattatgatattatgattcgattat

SEQ ID NO: 585 - DNA, 61 bp, Homo sapiens
ctgtaaaaattgtatagctgcttatttctcaaacttggatccaatcaaaagtcacacatta

SEQ ID NO: 586 - DNA, 772 bp, Homo sapiens
gctacacattacatttagttggtcatgttaaatattatttgcaaaacacataatcgtatattactgtggtctgtagatatttttctaaaataacaaatgtacttgggaaaatcttatatttgattgtacactcataatgcatgttttcatataattgaggtaaaaatcaactcaactaaatttcatgtttctgatatataaaaacacacacacatttttccactgaaatgagcatgtttggacatttttggtttgcatacacattaaaattggccgaagatgtaaacttgaaacttggcaagattgtaagaaaataaggccagagttagaagaaaaacacttcaagatttaaatgacacaaatgattagaattatgagtatacaaaaatgaaagagaacattgtctacctttaaggtcattctcaccagtcatctctgattgggtggctaaaagtcaagatgaagctaaaggatttatgtaacatgcaaatcaatccaatgtttatgtttcagaaaaatcaagcagttccaaagtaaagcattctgtgatgattttaatttggccatggtttgcatttctgttcctgttttcatagatatgtataaacttggcctttcccttggccttcttcccgtaggctctcagtggttgccctcggaagtgctattttctttctgtgtacattatggccctccagatgcactgcacttcctttgaatgtgcaaaaaagatgaggactataagcacacatcagaggataaagaattagcc

SEQ ID NO: 587 - DNA, 616 bp, Homo sapiens
tggagagagagaaaagaattagcctacccttcttccattgtaggctagcttggaataatttgtcttgacacaggatatttcccaatccaacgagtttattcacaatgatcctaaggaaacaaatcatgtctgtgttgctaacttatactacacattaccaaatgcaaaaataaatatcaccatagaccagcttcatttggaatgccaaagtttaagttttccaagtttagtcttaagtgagcatagtttagctttacatttcattttcatatgtgtagataaatctgtacgtccaaagctcagagagacacatggcaaatatttcttgaatgcaatgaatgcaacacaaacataatgaattaaatatttgtaaggacctatgccctgagtttggaaattttcctgactagatgataattttatccttttgagtgccattaaaacaaacatctttttttcctccttatagtcatggtttatagaagtttaaaagtttgatagcaaggagctaagcactgtttttttaagcacttgtttgagcaaattaactctaccttgttccaaattcttttacaattagtttgagtgacttaagaagagagtgcactgtagatag

SEQ ID NO: 588 - DNA, 577 bp, Homo sapiens
tatgatacactgacgtactacattgtaagaaatatttaaaaattaagacatcatcctatacaaaaatgtaaaaagtaaccacttgcaaaggatttacttgtaaaaagtgctgaaattccactaatagtgggaatctgtggcattaatgcctggggttcctcccatttgtccctgctcccttccaccttcctctgcttgtcactaagacaattctattatgttggggagctctcccaacagcagctctcttagcctaaattgtggtcttttcggcagactatatgactatccagacgtttaacagggagatccgaaaaatgagagcaccatggaaggtcttgctaaactctacacatccccggctgactgcaagctcacacaaaggcagaggagacttgagagggcccaaactttccatccatcactgattgcctggaaagctgtgcatatgcaaggggaacctggaagggcccagtggaaagtaaaagttaggacagaattgaaaactgccgaaattttgcatatgtttctcaacccacatatgtatctatcagcagatgacatcatcaggcatgct

SEQ ID NO: 589 - DNA, 37 bp, Homo sapiens
atgttcaaggaataaaatagtatttaaagaaacggag

SEQ ID NO: 590 - DNA, 31 bp, Homo sapiens
tacacagcattgaatcaacaaatggggaata

SEQ ID NO: 591 - DNA, 32 bp, Homo sapiens
accatgtaaacatcaaataaggtggaagacat

SEQ ID NO: 592 - DNA, 48 bp, Homo sapiens
tgggaacaggaaagggagatggagagagagatattaaaggcaaaaaaa

SEQ ID NO: 593 - DNA, 107 bp, Homo sapiens
tgtgtgtgtgtgtgtgtgagagagagagagagacaaagagagaatgaatgacaacacttttgatacttacctcaaactccacacaaaaattaactcaaaataaatca

SEQ ID NO: 594 - DNA, 3093 bp, Homo sapiens
ttagattatttatagttttgcatttgaagttgtagtctctggactattttgagtaggtttttgtgttttactttgtgtatagagtcatttcattctatatggcttccaaataattcttccatcaccatttatgggaagggtatggatatactggcctttatttcggtttgaatttccaaaattatgacactgaataaactgaatattgaattttataggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattggtgagtaaaaagctcctgtccacggccctgagtgccaaggagtgagtctttagagcactcagcagaggaagaaattcatctagaaaaataaagcccccaaatctcactatttggagtacaccctaatatcattgtcaacgtccaagacacagtggctgctaatatatattcttacagtggcctctaatataataatcacactgtgctctacattactatgatatctacaccgtgccctaacacctatataatattcacaccatgcgctaacactgatgtaatccacaacatcgcttccaatactaatgtaataatatccacaccatgccctatcactgatctagtccacaccatcgcttccaatactaatgtaataatatccacaccatgccctatcactgatctagtccacaccatcgcttccaatactaatgtaataatatccacaccatgccctatcactgatctaatccacaccatcgcttccaatactaatgtaataatatccacaccatgccctatcactgatctagtaatatatattcttacagtggcctctaatataataatcacactgtgctctacattactatgatatctacaccgtgccctaacacctatataatattcacaccatgcgctaacactgatgtaatccacaacatcgcttccaatactaatgtaataatatccacaccatgccctatcactgatctagtccacaccatcgcttccaatactaatgtaataatatccacaccatgccctatcactgatctagtccacaccatcgcttccaatactaatgtaataatatccacaccatgccctatcactgatctaatccacaccatcgcttccaatactaatgtaataatatccacaccatgccctatcactgatctagttgacaacatcgcttccaatactaatgtaataatatccacaccatgccctatcactgatctagtccacaccatcgcttccaatactaatgtaataatatccacaccatgccctatcactgatctaatccacaccatcgcttccaatactaatgtaataatatccacaccatgccctatcactgatctaatacacaccatcacttccaatactaatgtaataatatccacaccatgccctatcactgatctaatccacaccatcgcttccaatactaatgtaataatatccacaccatgccctatcactgatctagtccacaccatcgcttccaatactaatgtaataatatccacaccatgccgtatcactgatctaatacacaacatcacttccaatactaatgtagtaatatccacaccatgccctatcactgatctagtccacaccatcgcttccaatgctaatgtaataatatccacaccatgccctatcactgatgtaatccacaccatcgcttccaatactaatgtaataatatgcacaccatgccctatcactgatctagtccacaccatcgcttccaatactaatgtgataatatccacagcatgccgtatcactgatctagtccacaccatcgcttccagtactaatgtaataatatccacaccatgccctatcactgatctaatccacaccatcgcttccaatactaatgtaataatatccacaccatgccctatcactgatctagtccacaccatcgcttccaatgctaatgtaataatatccacaccatgccctatcactgatgtaatccacaccatcgcttccaatactaatgtaataatatgcacaccatgccctatcactgatctagtccacaccatcgcttccaatactaatgtgataatatccacaccatgccctatcactgatctagtccacaccatcgcttccagtactaatgtaataatatccacaccatgccctatcactgatctaatccacaccatcgcttccaatactaatgtaataatatccacaccatgccctatcactgatctaatccacaccatcgcttccagtgctaatgtaataatatccacaccatgccctatcactgatctagtccacaccatcgcttccaataccaatgtaataatatccacaccatgccctatcactgatctaatccacaccatcgcttccaatactaatgtaataatatccacaccatgccctatcactgatctagtccacaccatcgcttccaatactaatgtaataatatccacaccatgccctatcactgatctaatccacaccatctcttctaatactaatgcaataatatccacaccatgccctaacactgatgtaatatctgcaccattccccaacaccaatacaatatccacaccgttccctaacactaatctaaatatccataccatgccctaacactaatatattgacacaatggcctctaatactaataaatataataatatctactaagtggactctgttgacattgagactttgttaagggttttacagctttggctgaactatagcctctgtaatggattttgatgatgtgtctgctttcctggcatggtattgacatggttgttttaaaaagtaacttattttccaataatgtcatatgtctaggcaacttccagtagtagtacaaagtacagcttgtttcttcccttagattccccaacagttattgctgtaccagatttgcagtgtcccaca

SEQ ID NO: 595 - DNA, 52 bp, Homo sapiens
tcatgccacacttgggagtataatgtgttttgttttttttttattaggatcc

SEQ ID NO: 596 - DNA, 100 bp, Homo sapiens
catcttaagtggttacagtcttgtaacttagtacccatattttcttaaagaagaaatgaattagttttaccattttgctgttcctgcacttagctcttta

SEQ ID NO: 597 - DNA, 52 bp, Homo sapiens
gccaggcacccgggctcatacctataacccaagcaggttgagaggctgagga

SEQ ID NO: 598 - DNA, 274 bp, Homo sapiens
tactgtaaataatttcacattattactaataataaattattatttgtattacactattacataatgtaaaggctattaagacatgtttgtcttcaaagaatggccttggtttctgtgggcagtgcctcctcatggaagggtaatgcattcctgctaaatcatggacaaaacgggcttccaggagctacaggctgcagcagcagctcctcctctaagtccttcactgcctcaaactcttgttgactttgtaagcttctttcagtctagttttttc

SEQ ID NO: 599 - DNA, 334 bp, Homo sapiens
cagagccgtgtttagattcatgtgggaatattgaacacagaaatgaaccagtggaaacatcctgtgttccaaaagcctactcaagccatttgttcttattttaaggaaaatctttatgctaattttaaactccaaatacttatgaatggcagagatctacagatttgattctgatgtaagaaatgatggtcaccagccggttactgctaccaccccacaaccccgagcatactggacgaatgtctaagccttgtggttagtggggacaatgctggtggagtctgaagttgtcatgcagtgactcatgcaagcttaggcagatttggtgatatat

SEQ ID NO: 600 - DNA, 82 bp, Homo sapiens
tgaagctgtgtcgattgtggtaaagagttgtgattctatccagaacgcaataggtagcattctaaacagagatcttttaaaa

SEQ ID NO: 601 - DNA, 445 bp, Homo sapiens
ttttagaaagctcaggtttatgatgtgatggagaatgcctacaagagctcttgttttaaatggtagagtgaacatacactggaattctatcctgcttgacccaagctcttgatagcgaaaggtagaaaagatagatggtaaatagatagatagatgatagataaagaaaatacatagctgttccagaaaacagaaatggataacttcatgaaccaaaagcagagtaatatgctttagaaaggaagcaggccggaaaacccacagttgcaaaacaaatagaatttccaactgcctcttgtagccccttcctggaagtagtcacagcccagggtgttcgactacttcctctgttttttgtttgtttgttgtttgcttttctgtggggtttctgttgttgttgtttgcttttaaaaaaaaattccctttccctgcttttttgtcacag

SEQ ID NO: 602 - DNA, 366 bp, Homo sapiens
gtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtactaccctaatgaaacctttaaggcgctacagatctttgctgttttcagttccctccaac

SEQ ID NO: 603 - DNA, 45 bp, Homo sapiens
ccggcaaaactcagtcttgttgttttcttttttctttctttcttt

SEQ ID NO: 604 - DNA, 85 bp, Homo sapiens
atgagcctctgagcctagcctcaggttagccatattttttgttgccttgttgcgtaatttcccattctaacccaagcttatcaag

SEQ ID NO: 605 - DNA, 227 bp, Homo sapiens
ccctggatagctataagtgatccagaaatctcacctgttaggaggttcatagttcatagcgcatgaccattgcagagttcctagatggaagctaaacacccagtcctttcgctctcctttaattcagtgaatgtcgctccataaacctcacattccttccagagttgcttattttcccataaaacaggagctgtgagtgagtgggctgttcaaagtttccctcttct

SEQ ID NO: 606 - DNA, 710 bp, Homo sapiens
cctcacttgcttaaccttactttgtttttcgtaagtgaattgctcatcctggcctttccctcattgtgcctaaaccgcactttatttctcataagctaattgtgcatccttgcttaaccttattttatcttttctgacaaaattgctcatctttacttttagttcttgtaaccaaattgctactgcaacccctttccacttattttccttatcttgcatgttctaactcattgcttactcccgtatctcttactgcttactgtcttatttcatatgtcctgtttctgctatcttgtatgctttgcttttggtattgcttcagctagcctatgtccaacgggtccccttcacccctgacttcctctgccattctcctgcctcagtagtacccactgttccttattactccaatccgaagatcaagagtcagctgaaatttgttatttcagcgtttctccatccctcttcgcttgtttggtaactatttagctccagtccaaattccttggttgaattggactttgagttttaccagagaggtcattatactacatttcaagcagcaggaaaatcactctatgatggagtcaagaggagacagtgactcttggattgagtttactaattttagtctttgttttagcagtattttgtcagtcttaattcgtggtgctcggtagtttctggaacatactaagtattcaatactt

SEQ ID NO: 607 - DNA, 235 bp, Homo sapiens
tacaacttttttttgaaaaaaattgacttgaatagcataatcagtcagttgtgtggtactgtgcttcacacctgctgaagagaaagaccaaatgactaggtcctttcttctgccacctctgcccagctctggagatggactttttgtgtcactctagtcagaccaaacttgccaaggttggaccaagttctgctacttttcactatttcttttgtccagtcaacctaaagacatc

SEQ ID NO: 608 - DNA, 189 bp, Homo sapiens
tttatttttcctcatctctctgagacatgtttctcctttttaatttaggtatcttttggataatcctgatgttgtcagaggaaaatctgtattagatcttgggagtggatgtggagctacagctattgctgctaagatgagtggggcatcaaggatcttggccaatgacatagaccctagtaaggattc

SEQ ID NO: 609 - DNA, 38 bp, Homo sapiens
tcatcttttttttttctctgggataaatatgtacacat

SEQ ID NO: 610 - DNA, 93 bp, Homo sapiens
tcccctgaggtctgagtagatggtgcatttttcccaagaggatttgtgtctgccagacatccagagtaagcacttatgttaatttatgggcta

SEQ ID NO: 611 - DNA, 933 bp, Homo sapiens
atgtatttggaaattgtggtatagcttatattgggataacctttatacttctctactttaaaaaacaactttcatcaaaaaggaagaaaaatatattgttagcagatcttctaaattatttaatcaacatggaattataacagcctagcatataccaattcattttgtgctttttttttttttaagttgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaagactatatatata

SEQ ID NO: 612 - DNA, 54 bp, Homo sapiens
tagaaaatataaatcagactagagactggaaatttttgttgttgttgttgggtg

SEQ ID NO: 613 - DNA, 44 bp, Homo sapiens
gtattactgggtatttctttctttcctcctttatttctttccat

SEQ ID NO: 614 - DNA, 1505 bp, Homo sapiens
aaaaagaagtaagggtaatagggaatactgggtactggatggggtacagatattttaaacagagtggtgagaaatagttaatacagctagcaacataaaaaaggagaaatatcaaactgcaaactgttttaggaagataaatccttcatagacccaaagaagctcacaatttagatgtcgaaactagtttctgcaaaaaggggaaaatgtgattgacttggttaaatattcagtattaaattttattgaatttgtctttagaaaaatttcatagttagaacaggccttacccattttgcacatatatacatatgcaccacctttgcagtggcaacatatatatccacactataaacataccacatttataaatcttgtaaggacaagaaatggagttgaataagtaccccccaacatatacaagaaagttagcatacttaccccgtttttcactacatcagaggcaaaataagaaatcttttaagaaaatctcaagactggctcatggcaaaatgaatatgctaaatttgggggttggtttaagcgtggtatgtgtcaggtaattttgtgattaccaaaaagttttcacttgaaaactaagacctttgctgtttatttcacaatgtgaaatcaataaacctgaggatacaagtctctgtagtgatattctgtatttactcatttttacacatttttgaatgcaattttgctaaggaaggaaagcttacagatgcataaaatgtaactgggaagagtagccataaaaatcaatgaatggatgtggctgggcaagagcctctgtaatactaatacgctgaatggctaataagtcacttcatttcggtgaaacaaatacctaaattctttgaagaattaacaggcttgatgttcaggtctgcttttggcaaatgggcatttaaatactccaagaaggtaagagccagaaaataggaaggtaactatgcttttagaaatatgtttacttagattctcccaaggtttatacttacaggtaaacttagaacaatagctcaaatacctacataggagaaggaaatctcaagggaaaacagttaattttaaagttatttaagaaacagaatccaacaccatagatcagagttcatgctaggattatcatttcaaaaataatgactcatccaacagatatagaataatagcactttaaagatgtttaagagtaaagcacaaaccatgtatataccaagacttagctaattctctgagagttataacttaagacaataaaataattaaaaatagtgttaacattaagtagaatgcaaatctctatagatggtttcctgggaaagtagttttgataagctttcctagcattgatcatcttcaaaaaagcatcaataaacagtccatgtcacttgctttagtttgtttgggcctactaattgctccaacacttctcgggaatgatctataaaagaaaacaatgacaatatattaattgacaataaaaaatgtttaat

SEQ ID NO: 615 - DNA, 149 bp, Homo sapiens
attaggtgtagtgcacctatcatggtattacttgtttaaaaaaaaaaaacaggcatttgttgttttctctgtaatttcatcataattccaccaaccagagtaatggtctaatttcaccattaacctgtgttaatggttaataacttttt

SEQ ID NO: 616 - DNA, 56 bp, Homo sapiens
cacccaaagggttaaaggaggtagtagtcaccgaacgtgacaagttgacctgtagc

SEQ ID NO: 617 - DNA, 524 bp, Homo sapiens
gtacagtcgtgattttgatatggtttccatcctagttttaggatgtcttttaaaaatctgaattaaagcaaaaatactgataaaattttgttagtttaaatattactcataagtttaataaacttgtttccatagatacaacctatgttttatgtacaacatatctctaacctagtcttggaaatcctgtaatttggtggttcctagacagatttcacagaccagtagaaaaaaaaaaaaagatgggcccaacatatacagtgacaaaattttattttaagtttaacaaaattaagcaaaaataccaaggtttattgccagcaagagaaccagagagtgtatagaaatgaaaagttattatcattgggaaaacaaaggtttacaattttttaaaaaagcagctagtaagataaatgcagttttattcatggtcataaaaatattattggttattgtagaggaaatctcaatcaaagatagattcaaattatgttgaaagtaaaagaatggacaaagacatacca

SEQ ID NO: 618 - DNA, 395 bp, Homo sapiens
aacacttcccaatttcattttagctggtgtgtctacaatcattttggcatttttccaagttgtgaatatgttatcaaacatatataaaatttgtcttctgtctacatttgtcactattctgttttgaattcactattgcacattataggaagatgcttttccctccaatagtaagcatgtaacatttttatgtaattaaaaatttttgatgccagatggcagtgttatattacagtctccttaggcagcttcttcccatgaagatagagtatttaggactgtgggtttaaataagaatattcaatgcctttattatgctacagggaaaaactatggggtcgctaagtatttcataatctcttggcagaacattttatagaaacacatactctctt

SEQ ID NO: 619 - DNA, 124 bp, Homo sapiens
tcacatactctccagactgaaaaagggctaacgggtcatttatgctaatcacccgactgatgcttgatgtcaccttcctatttgtttctctatcctagtaacagttaagccactttacattaaa

SEQ ID NO: 620 - DNA, 132 bp, Homo sapiens
ccaacctctaaggaactgttgaccacctctgtaaaaatctatgacaatatagatggagagcattttttgaaagattcatggcaggagcacttggaacaccaagaagaagaagaaactatgggaaatacaaac

SEQ ID NO: 621 - DNA, 330 bp, Homo sapiens
aaagaatacaaacttttaacaaagtatttttttcaaatgttcaaaggaaatgtaatttagacatttttagagaacacacagtgaaaaaagtatggctgaacacatttttacaaataatgatcaaagtcctaatgtttcattacagtgatctggcaaaaataaacatgtcatgtaggattagtaatgaatgaatgaataatgaggaaacagaataatacaggattaagacaaatatgaaataaaaaaatgagttctcctttaagcaaggaaccagctttaattaaagggaaaccctgaagcaaaccacttgggtcttaaaatactgttttg

SEQ ID NO: 622 - DNA, 77 bp, Homo sapiens
aatttaaaatactgttttggctctttgtggtaaatcctgacatctacattatccagaatctaagtaaagaacttgct

SEQ ID NO: 623 - DNA, 301 bp, Homo sapiens
cttgcctttaaatcaggttaaaacaaatcctcagataagattaaaattcaagtcgactaaattgaaagcggcagatttcctgttggattctcctgcctctcagggtaaaacataaggactctctaactgctttattgcccttctaaaatcctccatgtctttgaatactgtcaaacatgcttagataactatgagaaacggcaatgcatgtctgctgtaggagattagcaaaggtatgtgaggtgaacttactgataatcattgaagacctaattgaattaaaatgctttagtaagtttta

SEQ ID NO: 624 - DNA, 56 bp, Homo sapiens
gatttagtaagtttaaaaattattttcatgctgttgtaacatctataaaactataa

SEQ ID NO: 625 - DNA, 653 bp, Homo sapiens
aaaaccataattttcatatttctaatagcagcttagtttttatctcttctgcagaaaccaactcagagtacttctaacagtttcaagtcctaattcataatgtgaagttatgttttattctaactaaggttaagaaattttataaatacttagaaacatagtcgagaaaataggttaattcaggagatctgatgggaaattacagtgagcagtgctaatctgggagtcaggttgctttgagggtaacaatattataattgcacatgcatatgcaagtatagtaaatactttctatataatataaattttatggtcttaaatactcatatgtgagcaaccatatgaatatataagaggaatcatgttatataaggtgtcacgaaagaagaaaggccttccatgtatcaaacaaaaaacccccacaaacacaaccagcatttatcttccttggaaaaagaagaaattaaaaatcaaatataaggtgaacatgttagcccactttacttccattcaatgatgttagcaaaaatatatcattatagaagatttaggggtactgatggttaagtgggaagagtagaagtgatctgggtagttaaaatttcttcagcttttttctctttagtttattaataaaagccattttatatgaa

SEQ ID NO: 626 - DNA, 48 bp, Homo sapiens
atgtgatgactcaaggtagaatatattgtatgaactcttgcattatta

SEQ ID NO: 627 - DNA, 235 bp, Homo sapiens
tcttgcattattattaatattagatctctcaatgttatgataattggccattatgcacaaggcaaagtcgagatccataagagttaagtgatttattcgatgttctggagagatggcgtggatgggatcagcgttcgttttactgtatcttaagattttagttttagtcttagcactattattattttattagacagcaagtctcagttaatgttgtgcaggctgatttcaaacc

SEQ ID NO: 628 - DNA, 99 bp, Homo sapiens
tgacacaaataacatttcaatatctcactttcctattctgtgaaatcagggatcagaaaaataacattttaaaatgtgatggagttggctagggtaatc

SEQ ID NO: 629 - DNA, 78 bp, Homo sapiens
aatagtggcatgttgcccttcacaaactttttggacatataaacactttttgttttatgttatggcacaccatgtaac

SEQ ID NO: 630 - DNA, 56 bp, Homo sapiens
tggggtcttttatagcctggggtttttatctatggatagtagacgttgagtgtagt

SEQ ID NO: 631 - DNA, 283 bp, Homo sapiens
gatatttttctgttccaataagatactaaggcagaactgacctcagacctcatatactagaagtctttgaagctattttttaaaaggcatagttatcaataagttatcttcactggtcctttgtggacaagtacaaaataaagcaatgataataggaatagcaaaaatgaatactaattaaattctgacttctaaaatctgataatgaaaagatcactgaccccaacaatgtgctggatgacaacatcagaattgtaagttcttttttttggttaattttaat

SEQ ID NO: 632 - DNA, 39 bp, Homo sapiens
agagctacgagttcttaaagcactttattctttgtatct

SEQ ID NO: 633 - DNA, 367 bp, Homo sapiens
gtagacatgagagagacagcttagaaatggcaatgatgggggttttaatgtactttcattattgttagatgaagaaaagccaagggttttaatattttatatacaggtggctttgagtctactgcatggataaggccaaactgggctcctgggggcgggagggcatcatgactctaagtggaaactgctatttcgagaccccaaggaacatgagaatgggacattcagttcgtaccatttccttcctcaaacacaacaattatttgtcctcttcctccaccaagatcaacctgtgtacaggcttaaccccatggaactatttcaccaagtaagactgaaaattgactacaatattaaaaggtggctg

SEQ ID NO: 634 - DNA, 64 bp, Homo sapiens
aaaaggcatttttatagaatcattctataaatgtcaccatgtggtctaaaaccagtaagcagat

SEQ ID NO: 635 - DNA, 99 bp, Homo sapiens
tccataagcatgaatatcagctctcctgtccttttgccaaaggatgaccaggtttgggcagaaaacattttacagtagggaggagaaccaccgcgggga

SEQ ID NO: 636 - DNA, 1133 bp, Homo sapiens
gtaggagaagacctagaaagccccaaagcacatcattacaagtgaaaaatagagcttaacaatgaaaatgcaaaacaaattagtatataagctgcttaagacaactttagacatataatcacaaaaatgatcctgcacgctttgagtgttcctctattttatttgattcaaggaaaaatgaaaaagccagacagaatcatctgtaaaactacacgtgatacattcttctaggaaaggtattagctgaacctacctcaaaggtcatttcgaggaggtttttgggaatctgcattactcctgtgtctcccagctctcctgatacacagatccaagggtttgatgtgattattgcattgctcagctttttgattgggatgatcactgacctatacggaatcactgaaagaaaaatgcagaaattaattaaaaagcgggaataaaattctccttataacaaaacatatattaagaactcttgttggttttcattgataatttgctttttatgagctatcaagatgtacttatacgaaaagttgagatcataacctttcagtctagaaagatgagatctagtttgcaaaccagaagtctcaatactcgtagcagtggttttcacagcatgtatatcatcatgtatgtatgatgcatatatcaacattaaacgtatgaacaatctcaagcattagcacgagaatacctaaagatgtgaacactgactgtgtatattgtgttttcattgcttaaattttcttaaaaattaattttgtaacaaaattgaatagaaatgaacatgattactgatatggttttatataaaaagaggggtggatgacttcttggacagtattgagtttcttgggcaatgctttaaagcactgcatttcagaactttcctgtcccaagtttacagaacaatatgcaaaaaccacaaataataaacaatggaacctccactctggacatatcgtgaagtctataaaccacaactttgaaagctattaaggtgactcacacgcaagaggagcccagggaggctcttccacagacagaccactagatgtcactgccctatcactgtcctttgctcaaatgtggaagcacgagaggttagatgttatgcatgtcctccc

SEQ ID NO: 637 - DNA, 58 bp, Homo sapiens
gggggcagatggtttaagcacataagcatttttgtccatcacagccatacatttctgg

SEQ ID NO: 638 - DNA, 670 bp, Homo sapiens
atttttttttttaagtagggtagaatcaatatttgttgttatccttgggatttctgcccatttgatcataagagggggtgttagaagccctccgtgaaagatctacaagtaggatgaaaaacatttactaaagaaggtgcctagatatagcctcacaatatgagctcatggttcagtgcactcttagatgaggaaaacaaatgagataaatggttcatttccctaattttacataaaagactttctttatgttaggtgaagagtctccctttgtgtccttttattttggctttaggataggaaaatgtcagagaaaaggccatatattcacggtttagtaatcatcagaatcaaatgggttttgaaactgaaagcagaagaggttagtgttaagactttattttaggtgccagaggcttttctcatttcttgcactgctaagaaaatctgcagaaaaaggcatgtttagggtcagcagttctgtggctgcaaaaggcccacagatgcacaacagtgatttcatagtttaagtatgaaaaagcaatatgattaaatttaaaaatttctttcatgaagaattcctcaaattgaaagagttactcagatgaagagaaatctacagatataaggaggattttaggaatcctctactgctactacttcttactta

SEQ ID NO: 639 - DNA, 97 bp, Homo sapiens
caattttaaaactgtatataactttttagtttcttacacctgcagtaacctaatcaacgaatagtaacttgacaggcattacaggatggcctaatcc

SEQ ID NO: 640 - DNA, 74 bp, Homo sapiens
caattctggccagtgaaatgttagtgatatttattgagattttttggaaaattatgtctttctagcacagatcc

SEQ ID NO: 641 - DNA, 107 bp, Homo sapiens
agtaaaaattctccaaagtaaggaagaggacccactgcaaataagaattagcaatgaaggaaagaataaatgctatcattcggctttctataaaaaatacatctctt

SEQ ID NO: 642 - DNA, 158 bp, Homo sapiens
ttctccaatcagcatttccttccaaagttgaatgatgtccaattgcataagtttattattaacacacagatactttgattttatgtgttttcgttaagatattgaaatatttacttaataaaacattccttttctcatctattgtaggtaacatttcc

SEQ ID NO: 643 - DNA, 307 bp, Homo sapiens
acatgtactatggcatatcttgctttaaaaaatataaatgcttttattgcattggtcacctcagtaacccttaacggtcaattctctagacttactgatagtggtgaacacactggtgaagcagaaatagtccacagcattgagagaaagaaggtggtaaagaaactgctctctttcttcttcgcaacgtagaaaagcatatcgcttataaagcttcctaggaaagggtaagacaagcacaagacagtagtatcaaagaaaaaaaaaaaaaaccaagacagtagtatcatgtacttttcattatgtc

SEQ ID NO: 644 - DNA, 29 bp, Homo sapiens
attttttttcttttgtttctttcccatta

SEQ ID NO: 645 - DNA, 160 bp, Homo sapiens
gtctcccaaaatgttgggattataggcatgagccactggggctggccctcattaagccttgactaaaaataaatagctcctcttagacaaacacctttaatcttgaaaaaatagattcattctatttcaattcataaaaatggatatataaacagttaat

SEQ ID NO: 646 - DNA, 206 bp, Homo sapiens
ctgatacggtgaaatgtttatggtacactgttaagctaataaaaaggatgatattgaatcgcacatatagtgtatcttaataagagaacatgcatagaagaaaagtacagaagaaaatgtgaaatacttagtgttctttatatagcaggattgtaagtgattatcattttcctctttgtactttggccactatgagcataaatcac

SEQ ID NO: 647 - DNA, 325 bp, Homo sapiens
aataactttttgtaattggaaaaaaaaaccacgccagttttaagaaaacaaggtcagattcacaggctatatgcaacacttcatgctttatcaaacctactgtttggacattaaaactcatctgaaaatgctccagggggtatgtaatccaagtgtgatatatacaaatacaaaactacaaaaagcactggaactctaataggctatcttgtttgaggtctttgttgaattctctgcctaactttgctccttagaagtcaaagtccttagccttcaaattagcactaatgtaaatataagggcaatatatttcatccaagacagc

SEQ ID NO: 648 - DNA, 89 bp, Homo sapiens
tcgaagagggtttcttgatagagtaaacagaagaaattaaaagttaacaattaattgacatgtacttgactggtttcccggctctaaac

SEQ ID NO: 649 - DNA, 247 bp, Homo sapiens
ccctaaactagtgaatgcaaggctctcagaagaagccctttactgggacctcctcacagaactttattatttctttctttttttactccaggttttatctgtatacaacctgtatacaggttttacaatataaggtttatacaaaataatataaggtttatataaattcatccgatcttttggatgttactgtcagcttgtgtgaactagccagctttttgcctgattctggcagagcaatccggcc

SEQ ID NO: 650 - DNA, 894 bp, Homo sapiens
aactgcaatctggcctttggctgttaaatttggtgtgtccccccaaaacgatcaagtattacatcaaaacagttttcaaagcacacgcctgttagataaagaagaatgcatgtgcacaggatacagcacttcatactgaagaagccagtttgtcagtttatgcaacttgttttgtatgcacatggattatagaaacagaaatgtatcaaagatggtatcttacttggtgagtggttggttagaaagcaactgcttaagatgctgggacaagagcttcttttctagagacagtcttatccacgcccgagctcgtccaacatcagtcttgatctcactcatgttttgaatatgcctaaagaatagtggcaacagcaaagatgtagattttaaggataaccctgactagaaaagaagtaaagagtgaacagtactgggcacagaaaggtttatacttaaagggagcaatggataatatacaattgatgttgattaaatctttgaaggttccatctgaatcatgaagttagtctcacatcataattgccattacaacacaagcacacggacaatgtggtaagataaagcatttaacacttattcactctttcaggctttattatgtccttgtggcagactcatagatatctgtaaataagaatttggttattcctgatgctccaaaaaaagtaatgaaacagggtgaatactcaagtttcttttcaaaataactgttctatagcataattaaatatcagtcacaactttaatccactgaattacttttcaagttgcactggacaacatatggaaaatatgaaatcttactttctatggcattagagaaaataagccagactgcattgataatctttaattgtttaattattttaaata

SEQ ID NO: 651 - DNA, 342 bp, Homo sapiens
atgacccactgcacttggatcttatgacactgctttaaacccatacattgtaagagttgactaagtattgtacctaaaatatttaaaagataaaagcctctgccttcctcattcaataaatctgtgttagatatcttgaagtcttctaaagatttcttaacagtaattccaagtgatgattctcagatatgtatttgcttcaaactaaatctacctgattgcaattgttctgccacatatcctgccattatttgcagaatttttcttctgtaccttcttcggtgggcagaggtgtttaagggagttttaaaaactgaacaaaagaagctataaaatagttta

SEQ ID NO: 652 - DNA, 458 bp, Homo sapiens
tttagagatgctttaaaactcttctcagctgcatcttccatttggatttaatgtcaggaaacactacaatggtataaaaataagataaatgaaatcataaaaaatgctttcttcagaatacataagccaaaaataaacacagccataatcatttgagcaatttagttaaaagccacaaaatacttcaaagttatcaccacatgctaacacatgtattaataacaaatacctcatgtcctgaataagagagaccctgagcgttggcaacataactcctgagtcagattttcttctttctggtccgagggcaactatgtagaaaaatatcaacaaaatattagaaaagtaataaaaaatatacatggttcatattaaatactttgaaactgcttcgataagaacaaattttaacaatatatatcatctagcccaaaatgtcaaaaaacaaattttaaaga

SEQ ID NO: 653 - DNA, 26 bp, Homo sapiens
atattattaacacagtaaatcagcta

SEQ ID NO: 654 - DNA, 119 bp, Homo sapiens
acccagctattttctttctatgtaatctggaactgcttttggaaattttaaatgaatcacaaaagactacctagcaaacaatgcaatgtgtacaaattttggccataaggaccaggcac

SEQ ID NO: 655 - DNA, 152 bp, Homo sapiens
agttactttctagttacttgttctaatagctctagataattacacatgaaagcaatgtatataaattaagctactaaaaaatgtgaaacatctctgggctcatgaactgaagtcacacaattaaactcttgagtgtttgaaaaaaaatctaa

SEQ ID NO: 656 - DNA, 192 bp, Homo sapiens
tctaagatttcggactcttcaatctgataagtttctaccttaaagttcagagtccaaactacagtaattacagcatgcaaagtgagtaatctaaatagacactaagtataatgtccatgagtattctcttatgaagcctgaatagctaacatttatttaagaatagctaacatttatgaaagctaacaatta

SEQ ID NO: 657 - DNA, 542 bp, Homo sapiens
tgtctcttatgtatgaaagaagaaagattattctcatatagcaacggctaagcaaacatctattggctaatatattgtagttgcagtgtttggtctcgtgctcaatgagatgccatggagtttaggcctttcatttctatcttcccatctataaataaaaatgaaattccaacatcatactcagcaaatacacctatataagtagaacttagaatgtgaatttttgctgtatattaaacctgccattttctcaggttttagattcattctactttggggggctgggatacaataccaaaacacataaatatatatgaagttggcactaaaggaagatagggaacattttggtgtattcggatccctatgcttttgacactagcaggtataaatgagtactgatggggttgccagaaggaagaggttgtggccagtccaatctaaaagcactactttcaagggccttccataccatgtggatgataaataggacatttgttgtggcgattttgggagggagtttcaatggggcactagaccca

SEQ ID NO: 658 - DNA, 148 bp, Homo sapiens
ggccacacaggcggtaagaaataggttgacagaggaaaaaaggggagttgaaaccataattaacaagttggctagagggagacacgacaaccagaagtaatcatgcctcttaaactagagaacaagtgagaaacttcattttaaataa

SEQ ID NO: 659 - DNA, 285 bp, Homo sapiens
gtaatttattagtgactctggagagaagagtttaaaagcctgtgagcagagggcaaattaggggttaggaaatggaaccacttcttttatctagagacctaaaatctaagaaggtttccatgaatcctactccagctagaagagaattttataaactatgtaaatgtatacttccattactatttcttaattgaaaatactcaaacaataggccactttctccttcaaaataaagattcatggatttaattcttggctacgagaatttgctcatctgcctgaatc

SEQ ID NO: 660 - DNA, 228 bp, Homo sapiens
tgaacacaagttaaacattttatttattttctatttggagtggtgaattttataaatgtagcacagacagcacgtttgtagagggcagggactgtatgtttctacagtaccatgtacagtctataggtaggtaagtaattaatagataatttctgatgaagataagatgaagagtgactcaaaattcctgggttagatccagaataaccacttaaaagcagcatttct

SEQ ID NO: 661 - DNA, 115 bp, Homo sapiens
ggcagcatttccactcccttcagtggaagggctctacacctaccccctgccaaaatccatttccagtttagtagaaccttgtctgaaggtgcaaagtttaagaactggctcaacg

SEQ ID NO: 662 - DNA, 303 bp, Homo sapiens
ctcccaacgaatttaaaggttaaaacttttgagtgatatgtcaagaacagtctttgttctaggaccaattgtattctgaacttctttctctgaaataggatttcaaactactaggtgcagtgatcactagatcaaaattaatactgcctacccactatggtccctatctttccattcctctgcaactcttaaaatgtctctgactcctgtttagtgctgcttctgaagactcatgataataatccagcatctagtctcatcatgattcagtgctagtaagaataatgttcaaacccatcaaaa

SEQ ID NO: 663 - DNA, 217 bp, Homo sapiens
catcataaatctttaaggatctttcctaaatatgacaatgcagactgtttattgccattcattaggaagcttaataattggcaaaaaaagtatttggtggaaaaccagattttaaaaacttaatttttgcataattacaacttattacttaagaatgagagatttcaatttaaactgatgttttaatacatatttcatattcctataaatatacatc

SEQ ID NO: 664 - DNA, 201 bp, Homo sapiens
tcattactatttttttaacagaaaaactggcagagaagatggacactagagaatgcttttaaacttgatctgaatctttataaatatagttacagccaaggacaacagaaccttggcattctgattacaggagctccagggcaatgtagtcagcttatattcctagctgtctgattaaatacatttaaacactaggtttct

SEQ ID NO: 665 - DNA, 338 bp, Homo sapiens
catttctgaatgtccaaagtcatccatactttttgaaaaggttccgaaatggctgattcagtataaagcaattttatctcaattagcttcccatagttacttctacttttttgtgaaataaatggttattttacataaagaaaagcatgtgttgttgtgaaaaatacacagtaggtagaacacttagcttaaaaaatcctacataattagctaaaaaattatgacacttctaacatgttatattttctataaattgaagagagattcaactcctgaaatttttgagacatatgtacatattttctccctgaaagatcattaatgatggttataaaaac

SEQ ID NO: 666 - DNA, 53 bp, Homo sapiens
ataaaacttgtaagaaaaaaaaaaattctaatgctagtgagagtaatgtatcc

SEQ ID NO: 667 - DNA, 1572 bp, Homo sapiens
ttgctccttctactttatcccattattggcaaaatgagtaaattttagcttgagagagaaagagatcaagacaaggccaaatagtattgagtcttctcagagtccagtgctgctagttctttaccaatgatgtcatacctggtgattctgcaaggtgctcttgtttctcttctctgtcctgaaattgaattaaatgtgaccacaaagccgacttcccctgaaagtacaagatgtgtaaaaatttcataagaaataattcatcaaaaaataatttctcatccaaatcattcatattccaatagccatttagaagtctggtgacccaagctcactcattcctagttgtatgacattctgagcatcttctgcatgtatcataaaggtcatcctgtacctcactgacaagactaccaagagcctgggaaaaggaagcagctaagcaaagggccagcatggcaggcagaagatttctgatgtctgctaggttgttacttggttgtatgtaattagggctgtctacatgggctacattagtaaccatggaattaaaatgctctagcagcacagaatgtacttgtgtacatctacatgtaaaatatgtttggatatatggagtggcgataagagaaaaaaatcgaggtgagaggagaaagagaaaaagggaagaagaaagaaacatgcacacatcagaaaaaaatcagaaagggagactagagagacaaaagcaaagagaccatttgaatgatttcaccctgaattattagataacttaaaatggtaaggaactgttaattctggacagtgacaaaggcaaacatttaatggaacttactagggatacagcctctgcaatgatgtgctatttcatcctttcccgcttagcaggaaagagcccaaaccacctcctgctcatgggttatattttctttttctgaaattaaaatgcctgtggcatttttctagtccccttgtgacaaaagagcctatttttttttaatgacatatttgtctccttgttacatttcttaacagggctcttaactggccatgtcaccaggacctcctaaaactgttacctgcttgacctgcaagccatggctccatatcctctccagcaggtcacaaaggctggcgatcaaggtgttctcctccaggccggtgatgtttgcttctccatggccaagttccaccgcttcatgtcccatcttctccaccaacatgcgctttgtctaagaatatcacgtgtagtcataaggcaccccagcagtgaaaccaaaaaccaacaagtcaattactaaagtaggagacttggtttcccttcattatacttctatttgcagatttgtaatcaccttgggaaaaaaatctcttaatcttgatgttcaactaactggactaatataatttatatgtcactattttgtcagaaaaatggagtgtgactaaagagaatataagataatatttgtaaggcatccccatgttgaaaagatgcttatatacaacagttgtcaaattattaacttctgtgatattggggaattacagcagacttagaaaatgtactgtcag

SEQ ID NO: 668 - DNA, 1979 bp, Homo sapiens
tgtactgtcagaatatggaaccccatcctgccaccacaacttgccctatcactgccccagcatcttagcatactaaagattcttgcacttagtttgattgcacttaggtaaaaaccagaatacaaatgggcagctctaaattttttgagaactctaatttgtgaatgaaccaggactttacttctccttttttatcttttctttgttcatcaagcatgcaccaaaaaatggaaagaaaatggaaatcagtttcatgtaagttaatttgcatcagtcttagtagcttttataaaatgtaaaatgagagagaatctagctcttttaggcaagaactttaattcaccactatatactgatgctgaaaatagtagtacatttattgaatatgcagagaaggtactcaagaaatgactgtcaaataaataaataaaatcattagctaaaatgatgttttaagttttgtcaatttgtactgctacctccaataaacacaggtttctgagaggagaacgttgtgcaatatacacaaacctacaacacagctaaggtatttttccttatggggacaaaaaccatgtacaggcacaaataaggttgtacacaggtgcatacacagacacaaaagtgttgcctttcacataagatgacaacattcctgacgcaaattatgagtggcttaagacatccgttcatgttggtgaggaggagagcaatgtctgaaaaggtgagaaaaatggtagaaggctctcatgtcattgattctgtggggaatgaagaacccatggaggttcaatacccgagtaaagagcacatgaggtcaatgccacagtaaaagttttcttctagcaaaattacatgcttaaatgggggttaactcagttcatcttagcctcacacatggtgtaaacatgaatgcacactgtctggcatcagtgaataatacataccttcattctacattcttttaataagccttctacgaatttacagttggtctgtgcaataactgcaggagagaggtctgacagtttgggttgcctcaggttttttcctaaacttcgtgcctcttgcatatatttctaaaaaatcaaggagtatttttaatgcgtaaacattagctattcttctaatcttcttaaccttatacaaacaagtgcagagacaaatgaaatgcaaaaaagtccgtaagtgtatgtgcatataacaacaattaatgttttagtgtactaaaagacagaggacactcatatgccaccccataacaactgttaactcctgtgagaagtaaagtgacagaaaccccatcacgttaaaactcattcaaagtgagatgacatttcatttcatttagtctttttattgggaatacaaaaggttgtgaagtcaggactgtggttgggacaaaaaaatttaggtgtttagatcacaaatccaaggttctgcaggagcccagctgttctcagatcactgatttcctccactcctttccccatacagtaagacttaacatacctctagcctcctgggcagtgctctccaatctaaccctttgctctataatcaagtcacaacagtaaaatcaggagctttcgaatctggttgtaactaattttatgactcaggtgttatcaactaatgtttgtgcatctcagcttgttaaatgggcataaaacatgcccccctacctccccaaaaggctataggatcactctgaaaagcacgatgtgctccaagtgaaggtggcctctttctgtgatgtttttgctaaagccctaccttgccttgttctataatcaagagaaagtgaattacagtgttacttttggggtttgtggtaactctaaggtatcacagaaacttaaccaaatgctcttgagctttggttagtgaatttctattaaaaaaatcactacatgtgtttagtgcaagacatgtgctctctctcttctttctatgctgtctataaaagttcatccaga

SEQ ID NO: 669 - DNA, 517 bp, Homo sapiens
tcatctggataccttatgtttacatcaggatcacagggcagaattttccaaaaagtccaagtgacttaggaccatatttagagaataactgctctacattatatagtaaaagtagcagtttattggctggtagtggggggcagcatggagactgagacggcaagccagcacatcctcccacgggcacatatgtgaaatctatccttactatcttcagaggagagcttgatattataaaagaagatgtgtaaaatcctttgcattctttaaaaaagagagtttgtacatttaatatatttctcctttggaagaaaataatctgctaagtctggtacaaataaaaaaaatcccactgattagggattccactaatctgtttacctgctacctcccaacctttgtgacgaaaggcaaaattaacaaaataatgtttttttccagtccaatcattttaacagttgtctctaattctcaattttctcttatttctttgaccctcttaaaaatgtttgaagca

SEQ ID NO: 670 - DNA, 48 bp, Homo sapiens
tgtttgcagcagaaagaagtatacataaatgttatgagaactgcagag

SEQ ID NO: 671 - DNA, 93 bp, Homo sapiens
gagtttatttgatttttaaaatctatcaaccattaccagcagagaagtcaaatgtaacaaggtctatataaatggtctgaaggttagttttta

SEQ ID NO: 672 - DNA, 49 bp, Homo sapiens
cctgaatactttttaaagtcaattactggattaaaaattaaccactgtc

SEQ ID NO: 673 - DNA, 728 bp, Homo sapiens
ttaagcactgtttaaagtttatgtcctgttttatataaaggaaaacaagctagacggtggctgtcctatgagtgaccaatttactgagcccccagtacatatggggcaggtacagttattagccaacagtggattccatagggccatgtgcaaagtctccttctgggcatctctgctggagccatagaaatagcaacattccatggacatgcacagaaaggatacagggggcggcaaaaggcctctcttcacagcaagaagggaggctgcctctgcaaattgcaaaaacagagcaactgcctttaaaataaacaagtgatgataaaaataacatctggaggaaaaaacatatttcaagatgaaaaatataggagagagacttttcacaagaaatgcttttataatacagtctagaagtaaccccagatttcttctgagattactactgtgctcttctttatttctgcttaagacaaatgaaacaaaccactaggaactacctatgaaaatatatcctattattcaataaacactgaactaactgctctttaatacaggctctcccagaattttctagtaaacgccctagccctttacaagttggtgttcaacttgtgaagagaagaccattgtaaaatagatttaagctagtatgacataatgggggaaaactataagcaagatttctaagttgcttgttgcctcaagtgaacagtggttagtgcaag

SEQ ID NO: 674 - DNA, 926 bp, Homo sapiens
ctcttggcactgagattctatgttgatgactgaattttctgaccacataaaatacagaccaggaaggggaaattaaaattctgtggagataaaacccagcaaaagaaaggctatttgaaattcaatcacatctgtacttctggaaaacgcttaaataaaggggagtttgtatatttaatacatttccccctttgaagtaaggcaatttgctatctagcacacaaaaaaaatcccactgattagagacccaaatgattagttttacatgtcagcagcatagaattactcatattagcacacacaaacacagaaagggactaaacataacaagaagcagagagcaaaatggggagtgtgagttcacatctcaaggtcatgtgaggcattctagagctatgtgcactcacacatgtgtaacattcaagtaacaccaaagacaagattgggggaacatctggtaaagcactttcaagcaaagaacataccaggcagcactcagagaaggattttttaggaagtcgtgcaggaggaggtggaccctggtcccactcccagaatgccatggagttctgacagaccaaaagttccccggaaggctaagaggatggagaaatgccaatgacaggaaagcaaaaaagaaaaggatagggagaaagagacaagcagaacaagcatgcatatgataaaatcacagcaaaagagagggaagggaagaaaatacagtagccggaaaaaaaaaagcactacacaggtgatgcctcagttcttaataaaatgtttaaaatcatatatgtatgaacacaacaaaaacaagagatgtttgggatgatgttttctgctttatttttacaaatttgatactagaaaacagttaacaagtcttctgattgcatttctcttttgatcataagaaacgaaacaatcag

SEQ ID NO: 675 - DNA, 728 bp, Homo sapiens
actatatatatatgcagatttcacacagaaaaaaatcaaaacttacttgttgtataattatggtcttattttcaaagagtacaaataaaagtgtaaggatcttaatttaaaaatagttttaaaacactttcaaaaatataaagtagatttagagattcaagaaaaaaaactggtgccagcaagccaagaacaaagcataggcaagtacatcacactactccttataattatgcttgaaacttagaaatgtctaggcttctcatgcagacaatttttctcctataggagacatagtaactaaaaatttatcctcaacttgatctttacttgatgtaatacacagaaagacttgttttagagccttattatagatgtcttgaaattacaaaaatggaaaaaagggtgttttctgctatatgtccgtacaaaaggattaatattttaaactataactaaacagttttttttttaaagaacattaagaatctacacaatgacatctgctggaaggaataagcctagttcatggcgcttgctgtgaggcaccccaggaaggtagaccacatacctccctcaagtcgttgtccagcccaacatgctcagaatgctggcgaaggcgttctttcctgcgctgtgcagtggcactccgacttacccagcgactgaaacaatcaaattatttaaaaatgtgttccttatctttaaaatagaaagcattaaccattcaa

SEQ ID NO: 676 - DNA, 600 bp, Homo sapiens
gtagcagtatttagagagatccaacatatatttcaagtcttttttcatctgaagtcacacaggatgtattttctctctagaaatgaacatatgtgaaatgtctctgctcagggaagcccattcaggtttcagagtctaaggcttttatcagggaccaatcacaaagacatatcctgttatgcgattagccatagcaaccaaaactcaggatcacaacaatgagaccaggggtacatcatcaatctcaatgtttgtgcaaagcaaattagcaagccagcatggcatggtacattgctccaagtgtacacaacaaaatcatcaattagtgacataaagaacatcctaagaacatttccgagggtttgccaagggtcaatcatgattccaggctcccttggaggtgtaaggactgagcaactagacctacttgctatgtagatttatctcagaaatggcctcttaaagagaattctcatcattctagtacctcatttgtcaacaggatttatacactaaaattcaatcttcctaaagaattgagaacaaatttaataaggagtaaactcagattgcaaagataattgtaaagaagttaatgga

SEQ ID NO: 677 - DNA, 146 bp, Homo sapiens
gtgaatggcatcaatcgtgaaaggtatcacataaatatgaaaggttacacaactcttttaacctatttgcctagaaaagagtggtaagtagggcttattgagttgttttattttattttactttttattattcatttgtgtattaa

SEQ ID NO: 678 - DNA, 137 bp, Homo sapiens
attgtcatttattttgaatttgggagaagatatcacacccatttctatgttctggagcaggaagtctatcttctggagcagcattgcagtctaaatcactccttagttcagctacatccgagttcttatcccaggac

SEQ ID NO: 679 - DNA, 654 bp, Homo sapiens
gcaggaagtctatcttctatcttgggatgacttgaaagataacccaataggagcccagaacctaggcatccaagaataagagaaacgaacatgtgtcagatggagaaaacagaaactatggacatcaaaaggctaaattagggccagatatcaaggtcacactggtgcttttaggaaagtgaagtgtaaacagctgagagtagaactacaatgtagatgaggaagcaaaaatgcttagtatagggaaagcgcagaggcagaaaggaaaatagaacccacaagaattgtattttttcttcttccttcttctttcctatttctcaataaatacttacagaatacctataaggcttcattaagtatgtaagcactaagaatatttaatatgtgtcatgaagagtgatcttcaagtaaacatgactcacatgcatctggtgatcttcctaacctgtgtaaaacccttccatttgttgaatttggcaccaaaggctcttaaaggccatttgttgggaatgtgtggataataggctgacttacatctgtactggaaaaactctatctttgcctttggagaattatggacgtttggttttttacctttagcggatagaagggcagcaagatttgtcatgtgctgtttaaaatctgaatctg

SEQ ID NO: 680 - DNA, 143 bp, Homo sapiens
ataaaaactgaatctgggaaaccccagggtcaatttctttactgatggttttaacaagttagatcacctgacttgattatgtggccaaagggacagaaaacccagctggaaacttctgctttaccgctgtgcgtgcgcgcaca

SEQ ID NO: 681 - DNA, 124 bp, Homo sapiens
tttctcttttccccctacactacacagaagtaagttagcctctcctgaagccaagtttccttgcacttgataggtcaatctggtgatgaagtcgcatcccaccataacgaccctggggaatttg

SEQ ID NO: 682 - DNA, 125 bp, Homo sapiens
tgggagccactgtgcctggctgttctgggctaattttctatgcagcaatagatagatagctaattaatcaaggtatgaatctgggtatctggatgaaataaggctgaatagtacctttattttgt

SEQ ID NO: 683 - DNA, 635 bp, Homo sapiens
tcccaggtaggtcaattttacggagtgcaaatggaagctgagactcagaaattggtcctttcaagctgttcctgcccatgtacatcatagaaattcttcaagttcccccaagggtacacatcgcaatttgaccaccattggagaggaggtgctatgccattttgggaaatgctttaaacaggaaacagtgcatgtgattaaataaaccctattcagaaaggttccagtagattcagtttctgcttcttaggctacactcaacacggaaagccatcagaaactagggtcaaggctcaggcaggtctccttgggacaatagaacacatcatgcattggccctgcctcctgcctttgaagtttctcttccctgagaggtggaagacgggtgtcagattgcatggttcgttttagagaacgttattttttctagaataacttcctggtagtgtgtagattgtgtgacagagaacttctaattgtttctctcttcctcatacacatttaccaaacacagaacatcttgtccttcacacatttcacatggcaattctggatacatttagtcaacataggacatttcaagacatgattctacaatggctatttcaccagtgcataatcacatttttttaatc

SEQ ID NO: 684 - DNA, 105 bp, Homo sapiens
aatagctgactcttaataaaggacgaagatagcactccttctcagctgtctgcagttctttatatattggttaactctcatggcttcaattaccacctgtgcatc

SEQ ID NO: 685 - DNA, 112 bp, Homo sapiens
aaagaggctggggagaagtggagcagacagaggaaatgagagttgcccttggccatgtggtatttctttccttcacaaaactaagtgagggtggccagacgcggtggctcac

SEQ ID NO: 686 - DNA, 285 bp, Homo sapiens
ttggaccttagctggccccaagacatagttggtcaggtaagggaactccagcagtaagagtcagaggctaggcagggtgtgggtggggtggaatgggagtcaagaaaatgaaagccagatttcacctcagtgtggtagaggaaataatgaagttgactctatccccgcctcctgaccgccacctcttttggttcctcaagctgtagctctaagcaaggaatgaaggatagtgtcttagtccattcaggctgctataacaaaacatcataaacagggtagcttgta

SEQ ID NO: 687 - DNA, 122 bp, Homo sapiens
tggttgaggacaccaacgttttctagctacagattctcagtggcctcctgggcatctccattgggataccaggtcaggctctgtacagaagagcagagatagcagtcattggtgtgcgccca

SEQ ID NO: 688 - DNA, 64 bp, Homo sapiens
tagattatatgttaaaagcatattttgtgtgtgtatatacatatatacacatatatataatatg

SEQ ID NO: 689 - DNA, 59 bp, Homo sapiens
agctttgggctttgtcatcccttgaagtgttctaaaatggtaaacatctcacctccaaa

SEQ ID NO: 690 - DNA, 31 bp, Homo sapiens
aaacttccaaaatctttttttttttttttga

SEQ ID NO: 691 - DNA, 56 bp, Homo sapiens
caatctggaatgtacactagaatctttatagtgtatatgtattcctcaacaataca

SEQ ID NO: 692 - DNA, 45 bp, Homo sapiens
catgtgaacttttaaaaatacattcctgagtcctatctatgaatt

SEQ ID NO: 693 - DNA, 168 bp, Homo sapiens
tgctgttgtttcagaaccattttcccaggagccatctttttttctcctctgatctgtggtggtgttccaccccagtcatgtttctgtgtatgcataggacttcattcctggttttcctttctgtttcatagacctactttttaaaaaaaccctatagctaatactaaa

SEQ ID NO: 694 - DNA, 541 bp, Homo sapiens
tactaaatcttacaaacaagagtgtttgactgtgcttggccctttattcctgtataacactttttattgtttatttaggtggttttataactttgacaatcagtagtttgttctcattcacattgactgtagattttttaaagtggtgacaggtacatgagttaccaaggtagagagcttgtttggtgaatcttcatcctcattacatttctggacaatgcatatggagacggtatgggacactccttattcctttggcccagacagcttccttgagcctgctgtccatccacacatttggagtccccatcaccctatggcaaatttctgaatatcttagacagcttgaggggcatgcttcttggagctcactgcatggatgcaattatgaatattgatggcagtattcttaggtcaccacctgtggatggcaaaatggcccttcttcacctctcctttctttgccagcgccattctgccaggttcaagttgaaaagaaagactgtgagcaattccacaatactttcagaatcagctggag

SEQ ID NO: 695 - DNA, 89 bp, Homo sapiens
taaaatatgtctgttctgtgtgtattttcccccaatattttattattataaactttcaaatgcaaggaaaattttaaaagtacaatgga

SEQ ID NO: 696 - DNA, 172 bp, Homo sapiens
tgaaataataatacaatgaattagctacatgtccttcacttagactcgatcactgttaatttcatcatatttgtcttaacatctgtctttgtgtacgtaattttgggaggctcattttaacaaactgcaagtggtagagtcatcatttgtaactagaaaatctaattttagg

SEQ ID NO: 697 - DNA, 44 bp, Homo sapiens
tctcataacccagtctcaaaaaaataaataaaactttaaaaata

SEQ ID NO: 698 - DNA, 360 bp, Homo sapiens
ttatttttggtgccagctgcttcctcttgttgttttcttcccccagcaccaatctggcactggagtcatacctccctggaggtttcaaaagccttttttttttttcttgtaagtgtttgccccttgtattctttgaataaaaacattatgtgggcagggaccatgctttattttttaattgaggacgtatattttatgtcttatgtcaccgagtggaaatacagcaaactacctggcctctcagatttctgccttcagttccataaatcctcttaaactaagagagtcacccggtcactttcggatgggacagatacctcagtttattcacatttttcctgacttttcttaattccttct

SEQ ID NO: 699 - DNA, 260 bp, Homo sapiens
aatgtctctgaagttttttttcccttaaacttctccttttggacattccccttcattttccttttaaaaatctcatcctttccaacactttcagttgtaagaatttccaaatcaagcactcaatatcaaaacaatgtgtgtgacaaacttaaagtgttgaatctgactatgtcagcagaaagcataattatcgatgatgtatgggacagcaatcttgaattaaagaagaaggtgggaaagccccaaatctctcataaatt

SEQ ID NO: 700 - DNA, 581 bp, Homo sapiens
ttagcacacctctgctggcaggaaacaatttattttaaagatgacctgttacattaggtatttgtattgaatgttaccttatgtgttgaaaagggagtgaagagagaatatatatgtaatttcttgtgtatggataacatcgatgtaagtacaaccaaaataccaatgtaagatctgtacaccaacctaataacatgagcatgattgataggttgatcagtagtttggcttattgttcaatgaatatccactcccctctcccttctactgtgggaagattatacttcttgggcctggccctgtgacttgctctggcaaatgtactactaatggaaagacaggagagagaccttgaatatgtttgacttggctcttggtttgacatagctctcctagtcctgccattgttcataagaacaacatgtcccaccagcactgcttcttcagcctgggtcccagaataagactcaggaaacagatatgagcacaacctgaaccccagagcctaggcatctgagtgtcagtctgaggcacaattatcagctgacctgcagatctgccagtaagataaataaattctt

SEQ ID NO: 701 - DNA, 61 bp, Homo sapiens
ggaattcttgttgtaagccatttggttttggtatgtatgtgttttgttgttgttgttattg

SEQ ID NO: 702 - DNA, 146 bp, Homo sapiens
ggaacccctttccagtaacatctttctgacgacccagaggggactatagtgtggaaactcccaactcaaaggctaactttggttaagtgttggggtctgataacatctttctcatgaaccacaagtgggacaatactgaaaatact

SEQ ID NO: 703 - DNA, 600 bp, Homo sapiens
tttttggtgaaaggaaaatcatttagaaatacttatgcattttattttcacattctgaccttactgagatattaaacaaggccaaagagaggtcatgttaatactactttatagacaaaaattaactttatagcggtttgggtcttagggccctgtaacagacactgaaaacacacactggaataccatttaaagggtgaataatatattcatttcctggagaatgtggatatccctaagaacataacgtatagaagtagtgttaactatatctttatccaaaccagagaatctctttagagaattgattattgtgtctcaaatatttcaccttaaaatttacttgttactagaggaattacctgctttcaaaggaaaaatagacatgagagttaaaagcatatagaaaaagaacactaaacatatttctttggcgcttaagcatagagaagcagacccaaagataatttcttcaaatgttaagttagattagattgttttgccagttgattaaaaagttttatggaatgtttctgcttacttcacctcaaaattctcggtcttggcaatataactgaatacttattgcacaggttctgg

SEQ ID NO: 704 - DNA, 177 bp, Homo sapiens
tacttggaatatgtaaagaaaatctttgttttcattgtttattcctgttataaaattataagattccatattggaaaagctcttataaggaagtccctaaatcacaatttgagagacctcaatattagtaacaataataagaagcagaataaaagtaaagattgcatagttcttaac

SEQ ID NO: 705 - DNA, 107 bp, Homo sapiens
taacaactaagatagagtttgccagatagcaaccaccatcacacttcttgccattttgttgtatgggaaataaggggaattattatttctagggaattaagatggca

SEQ ID NO: 706 - DNA, 153 bp, Homo sapiens
tattttctatcacctatactggtggttttaccctggaaaattaattcagtcgctttcacttttctgttattacctataaaaagagaaactgaaatctacctggggcctacaagaagaacattaataattattaagtacaaaagtgaaatatgt

SEQ ID NO: 707 - DNA, 1636 bp, Homo sapiens
tgctcagaaatgccaggcaatattgtctctctcaatacataaatgttatcacttttgtattaattctggatatactgatgcttcaaagcaatacagatttagttcttccatatatttgtcaaatatatgcagtgtgtaacatatttatctatatgatgtattgtcctgcgttttaagattctataaataacatctatgtttacaggcaaaatgtcattagcgcatacttaattttagtgggcttttgagaatcataaaattttaagaaaacaagttgtaatcaggagtttaagcagaaaaaaaaattttaaagagaaagccaattgcataggagagtggaaattaaaatcttaacataaaaccttaatcatgacattttatctagcttttaaacccttagtttattaacatttctaaattgcagaacacagggccttccttttaatcaacagagaggctgatagctctagggaacatagtcactttaccatacaattttgtgtagatgactggagttgagggcctcagctcccttctagtcatttagatgaaacaatagaacatcagtgaaaatagacccctctggttttcaacaagggcagcgataacctggcacactatcgcatgagatggagaagactacagtagaaatgcagagtagggttgctacccaaaaataaaaatagaaattgggaattcaaatttcaactacttcaaaaaattaatctaaaacgtttaatgtccttttctgaaaccttcgagcaaaataactttaacttctatattatgatattccaagaggctatttttccaatgattttgagtaatttgtacaaacaaacccacaaaacttctgtagcctcagtttgtaattttattatattccataccattataaataccattcttgtttgtctgtgcctctttttactactttaaacagaacagtacatgaaggttgcttctatgatatgaaatgtgagaattttataccattctttatgacttttatgcaagtgattaagaatttacatcttaacatggataaccacaaaacaatttttgaaaacatttgtgatatctggatgaaaaggtataagaccatcattgaacacatatctactgatgattggacaaatcattctgatgattaaatcaattttctgtattgccatggaatgtacataaacacacgtataacattgtttaaaaaaacaaaaacaaacaaacaccattgaatgcccattatttggctctaaaccttaccatcagacttagttcttgatttcatgcctctccaccatggaccttagggaactgatagactgatccctgtgatattttacccattcacatctatcttcccttgtctggaataaaatagctcttttttagtctaacacaaatatcatctattcgtgccaccttctctgatttcccttagaagaatggattgtatgccactacatgtctattcatggcataataccactgtaacacgtatcagaatctgacatccattagagttgatagtgatctgctggagaggaggggtgcattttcaggtactttattcaccagtaagactcaaagtatgggatgtaattgtttagtaatatagctggaatgggtatgt

SEQ ID NO: 708 - DNA, 104 bp, Homo sapiens
tttgagaaatcacaaatagaaaataaaaatatgtatgactgaagcattatcaatttgactttgatatttatagaatatcctacctaagatagcagaatacacat

SEQ ID NO: 709 - DNA, 87 bp, Homo sapiens
aaaagaaaatcaatgaaactgagaatggaatggcaatagtgagaaaaaaataaacaatgaaataagaagtttcttcattaaaaaaat

SEQ ID NO: 710 - DNA, 784 bp, Homo sapiens
cccaagtacatatcctttactgtatatggtatatgctcattttcagttattagtgtttaaattgtaaaataactaatttcatgcctatttagaagtccataagtttatctacatattttctttaaaatgattttaaagtcaagaaatgggatgcttaactgatggcaatgttctctttgcttttttgaactttgtttttaatattgtccgaagcagccaatctaattcatcaatgtcttgtcagtttttaaaatgtgatgacagcctgtcagttgacaagactgtaggaaagcatttttactaccaaattgacattataacttgatgaatcctatgtttcaatgacagttattccttgtctttcaaccagcatgctctgtttggaattcagtacaagacatactatgagaaaggtcattgtttttaaaagtctctgccctttttaaagcctttccactttgaaacggaaaatacaaaacaacttttcacatttagaatcttgtatttttagaatattagttgccatacatagttataaatattttaaagctgcacgaatcgataacctatcacctagaacaaatacttacataaatatttactttgataacacaaagtgattatcaattaaagtgaaaaataagtgaaagtaattttctgtactgagagatagcttaactttttcaaacctctagatcattttaaccaattaaaattattgactccaaacatatgtaaaattataaacatatgtaaaattaagtaattttacagaaaagtaacc

SEQ ID NO: 711 - DNA, 525 bp, Homo sapiens
gttattcagaataggaaataaaacctccataactggttttacattaggttatatttctttgagctcccaaatttcatggaattccatttctattaccaatatccattgcccccatatagaatttgattgactaatttgtgcctgaagtcaccttgatggaagctcccaataatcccattttcattaatgttaattaaggttgttcttgtttctttgttagaaaatggaggacaaatacaataagtctaaggagatagtctttaatgtgaacccaaagctttgagatgaaaattttgagtctttaaaagctgtggtgaggagagcaattatatgcagaagagaattacatgctgaaataatccctgagaacatttcttgggaaggagatttattgttttcatattttgtttaaatatcatcttaaagcataatcagactggccagtattcaattgtaaaatatgttatagaacgatgctcacacatgtctttgacataggatgtatcagtcatggtgttctgtgac

SEQ ID NO: 712 - DNA, 509 bp, Homo sapiens
tgctactgtatgtccctagcaaatattctctagataatggcctgtgcccagaactgcagaattgtctacttcattttcaaaatcatccccagttattttctggagcccacagaaatattttaaatacgcttaggaatagaattcttgtattccttggtcttcagtcttctcaagaattcatatcattggaaacaatatgacttaattggggctcctgctggtgccctctgtaggactatgtgcttgtccctgttctctcccattactcattttagcctcctccccattacaggcctccatccctgtggaaaaaaatcagatcaagtgaattgatatctggagactccactgcactagatcaacagcaaaataagactgtctcattcgaggcccagtcaggatccatactaggtataaaactggaataagaattcatattgtacaggtatgtgcgaagattaatgaggtaatctatacctagttattacctctgagtttcagatgttgta

SEQ ID NO: 713 - DNA, 347 bp, Homo sapiens
ttttccaaatggaaacaaccactaaatgagcaggatttgaaaacttctctgctgtcgcctatagatgaatcaacataggacatttctttctctttctgatttaatatgggtataatgataggcaaatgatgggcaaatttatgatggtagtagtttttaatattatcaagaaactaagaatctaattgggaaccacaaagttatatcaatattattcaaaaataaagataagtatagcactgctctggaagactatttgaaatatgtcaaacaatggggaaatatttgaatatgttgtagtagatccaaataataaaaataattgtagttaatataccaaaaataca

SEQ ID NO: 714 - DNA, 290 bp, Homo sapiens
ctattaagagaagtacaagtcctcagttcttagtcctacttgtgagagaattcaaccaagagaccaacaattcataatgtaagcaaacgtgcactgaaggaaagttaagagcaggggtttattgaaggaaataaaaagcagggagtttattaaagtacattccaagagagaagcagactggtccagttggaaaacagctctgggttggtctggctgacagcgggggaaaagcagcagcggctgcagggattaagtaatagcagagacactacactctgaaagaggaggca

SEQ ID NO: 715 - DNA, 213 bp, Homo sapiens
taactgttccatgtcatgttcatgaaatttgatggaacttatatttgaggttgaaaacattcacgtttgccatattcttttgtaaagtgccttggtacatattatcccaatttttatttaactgtttaaaattacaaaataataggatttttctattttggatactaattttttgctcatattataaaatacagttgttgcttgtgatataga

SEQ ID NO: 716 - DNA, 559 bp, Homo sapiens
attttccagtttttaacgtatttagtttttgatctacccatttcctcctgccccaataagtaataacaggtgttagtttcttgtagattattttatataactttaaagcacacagaagcaaataaagatacagttttctccagctacttttacctaaaatataccttgctctacctaacattgttttgtaccttccttttcttacctaagatattgtaggtcttctataatagaaaaaacgattgttttcattatttttaataactacatataattcataatgaactgttctgtgttttctgcactattttgcagtctgtcaaatgtcagacattgacagatgtggactattttttcttctatatgttagtttatttgtaattcctgtgccaatactacattctcttaattttaaaatacatcttggtttatgaaagaacaaagactttttagctgcttattgcttgcaccatctataattatggtgatttgtttcttgttttcactcctaatatttgttaattttactaagttttccagaactatggaaaattgttag

SEQ ID NO: 717 - DNA, 190 bp, Homo sapiens
tgccttttgactgaagcttggctgtttgtgacttgctgagatagggctgcaaataaatgaatactcctaaattggtatgtgttaaaaaaaaccaaaacctcagttaggtacagttaatcatatagaaactcaaagtagagacctgaatacaaacttaacaatttcttagtatatttggtttttgcatgtg

SEQ ID NO: 718 - DNA, 552 bp, Homo sapiens
aaacctttaattgaatttgtgtaccagtttttaatcaatataattttatctgttcacctacatgtattaaacattctgtaaggatataaaactgtaaacagtagttaactaggggaatgtaatagagttgaaaggtaatgaggtatctcaaaacagtctatttctgcttttatttttttaactacaataagtgcacatttttatttgaccttttgaaaccagaactgcaataattctgctagaaaaataattataaaatgtatacaaaaacaaatacaagttgtgaggcttttttgcttttcttcattttccatttactcacagccttaatagcatcaatgtaaatttccatagcaacataattcagaaaaagtcaattttacaatatgcttctcagcatagtatcaagtgttttctatgcaacttggttgggtgtacagtctccagaactgacctgccctttggatgaccccttgttttcattaggtaaatgaatagctcatagtaaaggtgatatgggatgaaatgaagagatagggcaacgaaatgatt

SEQ ID NO: 719 - DNA, 947 bp, Homo sapiens
gttagattattttaggccccctaccatccataaatacctcacagtggaaatgttttgaaagcagacaacccagtcctgctttcagtttctgtcctttcctagctatgtgattttcaaagttacctgattttttctggaatataattctctttaataaaactttgagaagttaacagtaaagcacttgggaagggcttagtgttgttcatatttctagcagatagtatattactggtaattattagtttttacttcttattgacatcttggaatggtattaagggagttccaaattagcattatagagcactgatatttcattgtctaaacaggagtttacaagtgatcccctcaccctatgttagtatcatgtgggatattaatgtgtcttagaatgtttttctacaaaagttgagtccttgcacatccatgaatctatattaagaaattttttaagtttacacatttaaaggatggtagaatcctataaacagtatattaacaatatattggcaaatgtaatataaagaatcaggaaaaagtcaaccaagcaaaaaattgaatataaaattgagtctaaaaatgttattactgtattttcagctatcttacccatgttattttttaaaattttatattgttgtgtcagttgtaataaattttactataaagtggtcaattcagatttgaaggtcactttggtaattggaggtgagagtctccaatagtgatggcagttggaaagcacaacattttactttcatgaatgcaatgatttagttctttgacctctaggtggttaacatgatgtatagaacatttcacttctgatatatgcatgtgaaaccctgacaagaattaaaggcagagtgcagatttaaatttctggcattccccactctgcttgagtaattgctaaagttattttgaagtagtttagaaagaat

SEQ ID NO: 720 - DNA, 765 bp, Homo sapiens
tcagaaagaggagaatgggaggaaaaggaaggaaggaaggaaaaaagcaattgatttgcttattttcctttctgcacaaatggcatcctaaagaaaaaaaatgttttgaaaggtctttaatgtaaacatggacagctgttttagaaattgtagtatgtgcaagtttgaaagatacatcatgaaaaatatccatgctgaaatgtcaattttatagctctaagtgagaggtcctaaggtttagaagttaaaagtaagttaactccttgcttatttgaacattaagctgtcagcatggaagtaagtttaaaacttacgatggtctgaaaatgtggtgctaaatgaagtctgaagacctattaacctgcttaagatgtaaaccaggaactattatactccgctgttcagcctgtatcaaagtactttagagtagcgtacaaactactaggagttggacaatgaagctgactagcatcttttttttttcttaaacaaaatgataatgttagctgtttgcagtactcatttagtaaccgcatgcataaaggaaattgaatacttgcttgaaaatgagccaatatcccttcaaaacttttcagagtaatacagaactgagttctttaacaaattgaccaatattcagtctttcccttgttttagggttttgaggacttaaaggagaaacataacatttgtaaacatagctgcctttaggtgctaagtattttagaaaatgatttttgtttttacaattaattttgttaacgg

SEQ ID NO: 721 - DNA, 152 bp, Homo sapiens
cataagtgtgatcagattttcttttgcagtaaaaatataaatttctacttattcaatattatgtcaagcaagtatactttttaaaagcttcactaagacatttattatttgctaaaaagcaatgagatcaattttggttcacatttgaaaag

SEQ ID NO: 722 - DNA, 1365 bp, Homo sapiens
cataagtgtgatcagattttcttttgcagtaaaaatataaatttctacttattcaatattatgtcaagcaagtatactttttaaaagcttcactaagacatttattatttgctaaaaagcaatgagatcaattttggttcacatttgaaaagactgaaatgaactaaatccaaattacataaatcacaataaacaatcaaataagcctatcccattatcactggaaaaaaacaaactttggtatgaaatcattttccctagacccactgcttgagttttaaaatttaagtgggaaagacagtcatcaagtgtgttccacaaaacactcctgaaagtgtttttgaagggttattctaaaacattcgagcaagaaaccagagaatattgattcatattgtaatctagatagaggtcttaccaacagtaataaggagtaaagcaagaggtggctatgacacatttgtttctcactgagtttataatcatcctgtggagaagagatgaggaagccaagggaaaagtaatacaagctattacattatagcattaggtgcctacatatgtgatacattcactacgttccaggaaacataaaaaggggaaaatatctgattcaggccagtgatggtacctagattggatttggaagaataaataaaattggatggtttgttttctcctctatcactaacaggatgggcaagaaatagatgtgtaatttaatctggttctacaggatgagatatttccaactactgaaaatgagaagaacctcagtgacactggagctttcattttacatcagcccctttgtgatatggtaaatgtctcgattcataccagcaggactagaatatggacaagagacactgtcaatgtttttaattcagtgagtgacttgtcatcctccactttccaaataaattgctcattttgtacaggaaaaaatgtgcatttaattaatcgcttttgtctttttgtacatcttgtcttttgcaagagggataaaaatatgcatataataaaactagagagaacatataaactggtaaggaaagtaaaagttaggaaaaaagaaaacaaatttgtatattcaaatacacaaaataacttctataagcttcaatacacatttttagcctctctgccctggctcctgttcctttaaggttttcttcttttctagggaatattatcttaagaattaatttgacatggaattttgagaacagtgccttaactccccaaagtgacatgaattcacatacaatgggcacaagggtttcagttttacttattacaagcacatcatagaaggaaattgttgtatttatgtgttatcaggctagtttcagatatcctaca

SEQ ID NO: 723 - DNA, 345 bp, Homo sapiens
agttgttacaccataataagatgaattcctaatttggtttctaggtttgacacaaatgtaactctaaatggagtatagaaaaaggtcacatcttgttgacttcaaaatgtctctacccacttttttgctatgaagcaagcagaataattggcagcgatactagccttcttgttccccttgtccctgaatactctttgctacactctgaccctaaagacagggtgatacttttcaaaattctattcatgtctacctcatttcattcagaatttacaatataaccatggatgccactatgctattttggggccataatagaaactggactttgcgttattggttcta

SEQ ID NO: 724 - DNA, 37 bp, Homo sapiens
agcagatctcactgaatcagatgcagatccccgcatc

SEQ ID NO: 725 - DNA, 397 bp, Homo sapiens
ttgatcaggacggacaccattttgacaagattagctggtaccatggtgctgtttggggcaaatctgtgggacggcccaaatccctggccggattttccacccaagtgctcctgtggaggcttttcctggcccagaaacaagtcaaagtttgaaattaagttttggtgtctccttaagtcttccccagactgggaaacaatggcaggcagcaatatagttttggagcagtgtttacattttgatattcactgtaagtctttcctaaataatggcaaggcaacaaattagtttcagtgtaatgttttagtttcaatgctcactgtaagttttccccagaatgggaagaaacaactggccagtgtttaagttctgatactaagaattaaaggtataacac

SEQ ID NO: 726 - DNA, 941 bp, Homo sapiens
ttagttttaaaagaacttaatgccagattatatctctttacatacagcttttgctccaacatctgtccaatttgtagctgttatccctattcctaaataccaccaattatagtcatttctataatttcctctgtattattcactctttaatattctccatatatcattttgtaactcactttgagttcatattagatattattgagggcctgaaaaattgaatgaactagttgaattaagatatacctgtagattacattgatagtgtacagagttgctaaactgactttatccagttctttgacactaatttcaatctttgctgtaccacagattgaggttcccatttgctctgaggctatttccctcattcttctacagttttgctgcagctattcttctcttcccttattcccatttgaaattagtattctctaatgtgttacttcaaagttcaccctagatgaataattaattcttcccaagtgtatttttacttggaatacccttgttgtctagataagtgctatttcatgggtattaagtgtaaatgccggatatattaatgttaatgatttcatgggccagagggtttattaaaaaaacataaagagtatagatcaattttgcaatgtggataagtaaaaaacacagtcaaatgttagaggacaaagatccaaatatacgagaaaatcctcacataagtcagccaaaagataaatgactatgttttaataaggtagaagttgaaaaatagctattgggatattaagcaagtctatatacttatgtaagagtctccttaaaaataatttattttagtaaagtttattgttctaatggcatgtaaaaaggcacagtgaactagaagaaaacccaatgtttcttatgttgtgctactataacatgacaaagcttttttagaacagaggctttgggac

SEQ ID NO: 727 - DNA, 223 bp, Homo sapiens
tggggactcagattttgtgtccactccttgtgcttcattgcttttagatccttgaagcagcccatgagcacaggacctttgtatgcactgtattaattctctctcaatcatttttatctcataacttcttcccagctttcaattcaatcatcacttggggaagtctagtcaggctttgcttttactgaaacttcattcactgtgcattatttgtactcaatcc

SEQ ID NO: 728 - DNA, 530 bp, Homo sapiens
taacattgtatttattgcgtcaagcagcaaattactctatactaatagatgcctagatttgataccatagctcttcctatatgaagactggcatttcccaaggtaataattcaaattcattctaaaggtcctgacacatgtagttacataggtgtcacttcctggatcagacaggtctaggtctttattggcttcttgcttctccatgccttttatttcttcctatttctgtgacttctagagcttctaatgtgtctctaatctgtatcttctttctctttagtttgatgttttcttctcctttccttttattcttctccttcatatgttacaacagcaatagagaatatttccctgtgtcttccagtttaggaataaattaggatctatgtatcacacattacacagacatattgatactgtgactttgtaatacaaatatcattcaataattcccttggttgtctcagtattgctttttttctgtttttcctgtttagaactttataatgtagacaatagttacttag

SEQ ID NO: 729 - DNA, 1907 bp, Homo sapiens
cagttgtttaaatgctcaaaatcatatactatttataggtggaacaatgaccttaactttgtaaagtacctttttaatagttaaactaactttttgcagattataaaacttgataatttaaaactaaaattttggtttgggaagagttggtttatatttaggatcagacatatgattatacagtcacaataattaatgatagttcacttattttaagaacttggctttactttttgtctaccatacacctgaggttaattagataaatgtagtctttcatggcttgctacttaattagaagtgatcattgttacaaaaatgttggttatgagctataatgaatactatacaactcatgatattttatcatatcaccagaaacaatttatacatcacaaaaaaaaaaaagtattttcccccttgctctggtggccgctggctgttccattctccaccctacttctgtaactacattttaaaaatatattggcagcctaagttttccagtgatgacacatttgtgctggccatttgttttgagtttgttccctaagtgaatgcagaatctatttgcaaagataatgtgtgctgtgctgcaatgaaattaaacttttaccatggtttaaaagggaatggttgatgatgctttttgtagtttgtacagaaagacctcggccagaatttttctagtaaaaaaatgcagggcaatgctgttgtagttgttgtagtcaactttccagctttttatgtgataaaatatatatcacaataccgctctcaatatgtcatacagctcagagtagtatgtgaatctacttgccttggtgctccaactttcatctcagcttttcacatgtatggaacaagatcttgccaacagaatattgtacatatacacagaaaactaccaccacctttggagtttagaggtgttttaaagtactatatagagtgtcagatttcacagtaggaagtttatacacctgaaaggagctgacctatgagttgcacaaaggtcatacaagttgaattgaaaccagtgttattattttggtatatagatgtcccatgacttcctcaaaagaagtcacacattcaaatatccatgacccacctttataactaaacaccttttagaacaggctctatgtatttcaggtaataattctagtaacataattttttgttgttgttttctcaatgaaaaaaagttttcagtgtgtctgtaattaccatcttgccttggtttagtaaaacacactggaaatagtttattgtactttaaaaatttcaatcttttcagaggaacaagatggtaaactaagagtaagaatactgaagaaataaatagacgtagagagaacagataaaaatgacttttgggtaggagattcatttaagcaaaaataaggtgattagatgttttacatgaaggacctagacctgcaacaatgctggcttttacctaaatctcccagcacatatttaaggacatagtaaatgggaaaaaagagggtctttaaaattctgctgcaaagacaactttcaattatcaatgataaaatgcaataaaaataaaagcttctcattattagacatataaatgaaagatattacacagtggtatcattgcttccttcttttgcttcctaaacatatgtacacacagatgtacaacctttccacccaggaaaataaagaaagtttattctgtcttttcttaaacttttctttaaaaataagttgaaccattaacttatttctggaatgttaaatttaaaatattgcagtcctctttaggtgagtagcctccctcagaagtgctttaaaggatccattaagtctactcaggcttgttattttcactaacattggaactgctttagttcacctggtatactcccacc

SEQ ID NO: 730 - DNA, 141 bp, Homo sapiens
atcacaactacaaaagaaagcttaggtacagagatgaaagtcactttttgtgcagagatggctggcctagaagcagagtctaccagtcagagcctgcctgtatgcctgcctacatttagaatgctaaattaagaaagggtt

SEQ ID NO: 731 - DNA, 331 bp, Homo sapiens
aaagaaaaagaccaaccaaaaaacaaaaaaagaaagaaagggtcaaacttctagtttatttataccgctgtatttttaggcaactttttaatagtagttgattctatatcccaatttataacaaatcaaagtataagattagaataataatgttttgagtcctaaatgtataaaactgtcaacacaaagaaaacaaggtattttaagaagaggagtgcaaagaaaagacagcattaaaaaatttctttgaagaaatcttctcagcagtttgtactcttggtttccattttataagaaataaaatcacagaaaaatgtaattcttgagaata

SEQ ID NO: 732 - DNA, 50 bp, Homo sapiens
ttcagattagggatgctcaaatataacatatctgttataccattgaaagt

SEQ ID NO: 733 - DNA, 134 bp, Homo sapiens
gttagcaatataccctatacacttctaagagcacagtgcatgtaagctgagcactagcatgtgatattttacagcattaaagagacattcctttgtgtttcatgccatcattgtaagtgcgttaaagtttatat

SEQ ID NO: 734 - DNA, 181 bp, Homo sapiens
aatggctctacgtaaaaaagctgacagataaagtaaaatcagcagagttgttaatacaagaaatttgggggaattatattgatttaaaaacagtgctctcagagtgttctttaaaaatataatcctaatctattttcacttttgacagtccatttatcttatttgattatgtaagcattgt

SEQ ID NO: 735 - DNA, 384 bp, Homo sapiens
attcagatttttaaaattatgacactaaagattgcgagatgctttattattttagattggaataggcaacatcatttaaatatcattatttttcttatttatgtattttgtcaaaatatcctcttttgttttttacctaagcagtgttcttaaaatgccattaagctccactatactttacaaaatacattaataactcacatcgatactctcatatttatgtggttgcccttgcatcactatataattttcagaaattactaacctgaatttgcttattttaccttacatacattttcagatttattaagtcattcaagagtcctatttcattagctttgtcttcatatgagagcaaataaaagggatttacccaaaattaca

SEQ ID NO: 736 - DNA, 126 bp, Homo sapiens
agaaataaacaacaataaataaaatacaagtccaatccagaaaaatattttccctgtaattagtcttgcaaagaagcagtttcttagaatagaacagtgtggacatccttcacagacaagctgcaa

SEQ ID NO: 737 - DNA, 167 bp, Homo sapiens
aaaaatttctacatggggtgaaagaagaggattctggggacagctacagagggctgagagagaaagaactccattcagaaagctaatttatgtaacatggctaggatacacattagtcattctttaagagaagccagtaaattttaagttgtttctgttccccctct

SEQ ID NO: 738 - DNA, 32 bp, Homo sapiens
aactatacatatgctgtatatatactatatag

SEQ ID NO: 739 - DNA, 32 bp, Homo sapiens
tgaaattttctttttttctttttttaagttta

SEQ ID NO: 740 - DNA, 71 bp, Homo sapiens
agtattaaaaaaaacaacaaaagagtattcatttgcaaagaagtggggaaaaaagaacctttgtctattcg

SEQ ID NO: 741 - DNA, 103 bp, Homo sapiens
tgacagtggctggtagaaaagtactttgttgaatgcaactaagttttgagattgatatcaaagtgaaagcaaaccagtctattatttttctagttgaattcaa

SEQ ID NO: 742 - DNA, 814 bp, Homo sapiens
tcaaaacagagacactgggctacagatttataatataatttaaactattttaaaattctctataatattattttaaatattttttagtagacaggtaaaattatggctataaacctaaatggagtcaacaccaaaatacacttactcattcataaattaaatcagaataaaaatgctattttttgtttggtaaacaggattatgacttatttccatcaaatttccaagtgtgatcttttcttatttcctctaagtgtggggtagataatcttaaggagcctgtctcctccaatgtcctggtttattggtacaggtaatgtacgagtgctcaagttgttcatcttattctgtaggtttctctttccttggcttattgatatgcagaactgacttggtactttttcatttctgtcactttttgtggttatgttaatcattaataaaccctatagagacccatctgattggagtcagctacctgcttgtgccgccactttaataactgaccaaaaacatgcatttctccctttcattcacctggaagttgattactccctgttattgctaaatttgtaaggagagaagaagcaggtatgtgttttctaccgtcaggttttaattacaggtggtattctaactaaagatgaacaaatctgttttcatcatctatttatagaaagtaaaagaggttattaaaagagcttgttctaacatttttatgaggttctctcccttacgaatgtcttgaaagtcaaatttttgatgcgagtttaaatccccgcaatgactgtttgtaaagagattgctaagcaat

SEQ ID NO: 743 - DNA, 537 bp, Homo sapiens
agtcagcattttctggttcttgggaaagacacagcatatcctattaggtggtaggtagtttaaaatccttataaacaactgttatatacatttttaaaaagagggtgaccctagcttatacttgggttacacttttttatatacaagtatgaattttgatgctaataatctcttttttttgtatctactacattacctctaatggtgcaaaaatttccaatagcactagatggttttatcattaagaggtattggacaggtgagtcagttcttatattgccttgaataagtttccttccatattttaagttccacatcttcaatgtatgcaaacaaaaacaggcatttgattttaagccacaattaaagctgccttagagatattgaagaaatatctgttttagacaaaaaacaaaaactcttaaaagttagtattttcccttcaatattttatttatctgtgtataagtctataactaaattattatttctcataaaatattctgattctattaaaatgagtgaatcatctattat

SEQ ID NO: 744 - DNA, 276 bp, Homo sapiens
ataaaagtccatctctattgatatttccatgatttaaaattctggtgtttatattattaaaagcctcttcattaaaggtcatgactttaattattacattagattttaagtaaatgcattttattttattatttttacctctaaattgtaattttcttcaaaataatcctgagcttttgcctcttatatggaaacatctttgtgggatggatttgcagccttctgagagatctgctctgctgctcaaaatatgctgcaagacctcttcttgcccaa

SEQ ID NO: 745 - DNA, 355 bp, Homo sapiens
cagaaaaagaaatatagaaatggtgtgatattatcttttttcttattttattaccatttctcctagtatatattttttattcctgatttcttctcttgtttcaacaaactattttatttgtaatgtaatctttctttccttgaatctcaattacaagattatcatgacacattattccattattcttaaaagaataaaagtaggagaccatacactggctttcggaattggaatagaaaattgacacttcccatgaacatcagtttctaacacattttacatatgctgtgctttgcttcatggtccataatctagaaaacagttttcttttttttttgtttgttttcaactttct

SEQ ID NO: 746 - DNA, 899 bp, Homo sapiens
acagttttctttagaaaaagattgttgaaacagtaatgaattctattatatagtgcccaatatttatggacttagggaagatttgaagtaaagcaaatgcatgtttaattaaatctgtttgtttaattttagactatagattctcagacaatttaaaaaatatgccaaatatcaatttataagagatgccaaaatatcagtctcctggaagctagaaacttacttttctttgctcatctcatgaagagatgtgatctacagaaatacatttttcaaatagatctgatttttaaaatgttcttcttgaaacattacatttctaaaaatataaattcatcattctaagcaatatcagcttctagttttcaaatttacctctctggcctcttaacatgtaaataaaattcacaagtggagtcaacatgtagcatctatttccagatcataaactcctttcctaatctcttaaaatatgctttatcttcttaattttaaaatataattcagttatattcactttgagtaatctacaacttattttataaaatacattttaagaattattatattaattttttgagaactattgtgaaatataacttttgagaattattatgtacataaatgaccacgccaactggaaaattttgtgcatagttaatctagtgaactagaacttgaaatgccctaaccagttcctaaaaggtgttgttaatatgcataagctctgggaagtaggatccaagggcaggggaaattgaaggttctgaccttcttctggaaagatgaagggttcctttggatattcttgaggtattttttttttttggatattcttcctgtctctagacttagaattggcccatttctttttctgtataattttgggagttagcaaa

SEQ ID NO: 747 - DNA, 83 bp, Homo sapiens
caccttgaactttggtatatttattgaactcactgtctacctcctcctaaccgggaaactttgctcaacttctctgtattttt

SEQ ID NO: 748 - DNA, 42 bp, Homo sapiens
atattttgctttatacaataattgtttactttttattcagtc

SEQ ID NO: 749 - DNA, 1422 bp, Homo sapiens
ctgaacacattactttgttgaagataattgagatatgcatctgacaatgacatttatttaattttactctcagcccagacaaaaatgttgaatggtaagtagcctcaccttctccaagagagaaagaccaaattattggcattagattagtgaaaccactgaaatatgagtaatgtcatggcagaagtgttgattactctggaggtaaaggagtatcattagtgaattctgtaaccattgctctggaaaagacactgtggacgttcgcagttggctttgtgagcaaaagtataatgtcctcagctacaggtaaagattccaggaaatcaagtggccaggagaaacgtccaagttgtaaaattaaaattgagagtttatgaaaaactagaatttattgaacaggaaatttgggatatatacttcttctctgctcattaaaaatacataggagtaaaacaactgggtcggttggtttatacaagccttttaaaagtaattaatccattgaagttgagtctattacaatgattatgactatggaacttacatagaaagattcccagtaatttctatagccactataagttgctgcaaatgcatgtgataatttttaagtattggagattcaatgattatttgaaaagaaattattgtttgactgtttttttttctttttggtactattatcacatttattgctacattattttacagaaacaaaacaaacaagtctcaaagcagcggaagatcttgaaatggtttaaatttagagcatctaagaataaaaaggttaagcctttctcttgccgactactcagatctaaaaaactacaaaacaaaggccttgatttctgatcctgtccttttataattaaaataaaagagagagagctgtataaaagaaattccttttttcccaagtcactttttgatctcctttcatctttgcctctgctctgccctcaggtattttagagacgcttcaataaaagtgtgcattcctgttgagtgtttccttaaatgccacgcagctctgggactgactaagggaatctctgcttcacaagtttaccccttaccaagtgatgaaaacaattgcagaattaattcctgaggccaatgaatcaagaaattggacagcctgcagctctctttctagcttacaaaacaaaacagtaatttatcttgagtaattaggaccttctgatttttagcatttttttcctatttccttagctgctctattgtttaccacattgaaattatatttgtttcctagttacacggatttgatttttcctacaactttaggagggtcatctacagctatgctaatttgataatgtaattattgatatgctttgaaattttgtgatatggcatttgcagttaggttcattttaattttatcaactctgttat

SEQ ID NO: 750 - DNA, 366 bp, Homo sapiens
tccagtgtcagcttttcagtctcatgtaatactatcaaagacagaggtgcagagttggtctttggatgtaagggatgtaagtgtttgctgccagagtcatgacttatctttttattagagaaaggactcacgctagtctccataaaagtgatttaggatattctgaaaataatattgctatgtatcagcatatcttgatctctaaatcataggattgaaagaaatttcagagtttgggtgaccatatttttttccctgaaattgtccaggtttacaatcattgcgcatgataatcattaattttgttcctgttcactctctttcgcttttctcagtcaaaatgagaaattgtcactctatccctat

SEQ ID NO: 751 - DNA, 1335 bp, Homo sapiens
attgtgttaaactaacatttgttaggtttggttttagaagaaagcaagtacttgaaagagtgaataaagccacagaaagaaaattgtggtatctctttgacactttaaaattcattttcctatatgatcctaaaaaattgggcatattgcaataagcaattttcatatagatagaaggcatctgcttctcaaaattgttacatgtattcactgcattattaaaatacagtggctgcttagcatggcttgctttaacctaacaagaatttcttcattggtcataaatatttatagactgtggaattcttctgaaactatatttttagtaatacatcaaaaacaataataaatagatgttacatataatgtgatatttgattgccaaaacattatctataacaagaacaaagaactaaatcgccattggtgttttcaaatgttttaaagatttgtaaatattctttgatgaacataatgccagagatccatgttcacttaaaaagaaaatcagaaaaacaacatatgcaagcattatttaataaggtttttgttctaagttcatacttttcacaatattaaaaaactttagaaaaataatttatgattatatttccagtgaattacatggagtattttagaattctaaatttagatgccactgtgtccattgaataacctttttttttgtatagtggtaaaattataatatatagtgtggctcataaggacaacttccgaaagggtgaccaccctttagactttaaccttgaccacagtaaattctttctactattatcactggctgttttcacagatttgcagttttaataatctagttgtcctcaactctttcaacaatgatgggatcactaattcatccttccatgttttcataaattttaccaactacaaggaaagactgcataatgattttaaataattgtttgtcataaaaaatacagtcatcactctgaggaacatatttgacattatgttttatttttgtttttgcacatggtcaaacattgagaattcaacataattttaaaaagggggctttcacaatataggcttctagtggactttttatgacaaataaattgttcaaaactaaaaatatcaaaattgaatgtctaggagatttaaacgttgtaaagataaatctaggatttaaaaaaatctcgtttatccacattatttgtggatttctttaagcattctcctttctcttccatctttaccactttcactcatttttgtgcctaccatagtcacaggacagaggaggtaaaatttaaacactgtgtgtataatttagctacatcatatgttagt

SEQ ID NO: 752 - DNA, 94 bp, Homo sapiens
aaatgtataattttctaaatcaaaatttgcatttgggtaaaaaattatactactttctttggcatttctccagagaaaagttatataaactgct

SEQ ID NO: 753 - DNA, 25 bp, Homo sapiens
ttcttataaattaaaaaaaccctgt

SEQ ID NO: 754 - DNA, 30 bp, Homo sapiens
tttcatgtcactcctgtctttattgtagcc

SEQ ID NO: 755 - DNA, 631 bp, Homo sapiens
tcagtgattgttgaatacatgaaaattttaattctagtaactctatattactacaatcttttgtttcacctttcacagacatttaatgtctagatataatatcaactttaaaaagcaaattgggtatgtgacatgagtgattatagtacaaaacagtaagaagacaagtgttatgtccaaaataatttaacaaagaaggtggggagccaactttaccatagactttgaactttctcctcaatgtgatgtttgtattccattcagtttgctaatcactgtctttgagatattatcaaacaaatatctctgcatgtagtatcaggtgattgttctatagactttggctttataaagtggaatggaaataattaacacatgttttttcaggaacttggttctttgctttgccttccctgttcccctaatttcctcctcctccctatttccccattcccttctcccaccttgttcctctattccaggctccccgtctcttttttgccttacccatgcgtggaaatattccagtacttagccttaattaaccgacagacaatatagggttggaatgaattatgtggagcctggagatcaactctgtgaatgtacatatgcattacatggcttgcta

SEQ ID NO: 756 - DNA, 40 bp, Homo sapiens
taagaaattgcttaacttatctgtacttgaaattagtcaa

SEQ ID NO: 757 - DNA, 1371 bp, Homo sapiens
gtagtatatgtaaaacacaacagtatttatgtaaaacacgccctccctaaaggctattccttctaattttcctaacaaaaatatggatagggaaaaatatgtagtattttatagaaatcaattcgatcaaagctatcgtgtatatattttttcttaaactcagtgataagaatattcaaaattgtttccttatttatatatcattatttacactaaagttatgcaacttgaggttttatttgtggatgtgtctagttagagggaagaagggagagaaggagaggaaaaggaaaaatatatttttgagacctcacagttggtaagggaaaaaaaaatagttgtttggattttaattgttctctttagaaaaaaagttggtgaataagaatgttttaaatcgccctttaaaatgctacctgtagtactttaaaaagaatcatcttattatttctctactttgttgaatgtgtggaatcaagttttcttccgaacacactggtgtgaatgaatgatgtaaagcagagaatccacactttgcttaggcttacatagaattacacaaaacaatatacaattttatttgtaaaagcctacttgagattgaatgtagtctcaaggctgtatagatcttaatgggaacatgcggcttcctttcaccacaaaaaagtattttttaataaaaaatatatacattaaactggattcaaagcagttatttttattaatcacctagtgtggttatgtaccctctaccacagagaatgaaagacagaaagcatccattttctgcattaaacttttcagaaatacagctcacacaggttacaacattgcttaacagccttttcaaattaaggcaagataggaatcatattcattttctcctttcccattggcaccaagatgtaaatatagctaatggtagcctgttcaacactattattaatcatttttgtagcaacatgttatttgtgcccagatgtatgcaaatgctcaggttcctactgctccagatggtgtttattaagttaaagtagtcatataagcagaagcaagtgctctgctatgttcacacaaaagcaaaagcaaaacaaaaccagcacccaacagccttgaattgattaatgtttttgatgcactataaattttaagaatattccagaatccacaggagatatctgaaatttcaaaaaataggttgtaaagtgaaataatcatactgcaataatatttgtgcaataaaattttattctttctaaattatctgataaaaagtccttgcagttgtgataaatagtcgaacttgtgtatcttagatataaaattacatgcatttttatcttttagttgacattttatttgaactcagag

SEQ ID NO: 758 - DNA, 39 bp, Homo sapiens
atttgtatctgggaaaagaagaaattaatcctgtcatgt

SEQ ID NO: 759 - DNA, 568 bp, Homo sapiens
atttaggaggcaaaaatatttgcaaattttgtatttaaaggagaaacagaaaaatagcacattctaaaatgtgtatgtacatgtacgattttattgtacatttcataactctaatgcttacaatttcagatctctgaagcctgttaaagtgtttatgtactttgcctaaattatgtaggcttacttactgcattcatgagggaaaaaagtcactgtttattataatgcttttataagttccatgaggaaagtgattattgctacacaaaacttgatttcagagaagtaacgtgccaatattaaaagactaacaaaggcagagacattttaaattaaacctctttgacaatagaacccacactcttaatgatgtgctagatcaactcacctctttggttctaaatgcatatttgatatataagtcaatttgtattcactttaagcatgcggtgctcctgtagagcaaatagtatttctgcttgacaggtgaggaaactgatgtactgatggctcaaagaaataggtgccttaaggaagtcgacagtctattattagattaagatttatg

SEQ ID NO: 760 - DNA, 341 bp, Homo sapiens
gatttatggccatgtattttctttttaactgaatctacaatattggtttactatatgtacaaaaaaagattttaattcttttagtttggaaaatggatctctctctgatattgtaatatacttgctattgatatttaatcaacatttaaatatctatttttatatacccagactgctataaggtgaccaaaataaaacttatttggaagcataaattagttagctgaatcaaaagtagaatttcaatgtctatgtactggttatcacttttagtatgattttttaaagttaataatcatgagaaattaggcttaaatttttgtcctttattatggcgtgtc

SEQ ID NO: 761 - DNA, 735 bp, Homo sapiens
atatagaaataataattttttggccaaaacattagtcttataaactatctgaatatttaggctctagaagttctcacaactgccttttcttagtggccttcccagacactttcaactactaataacgggaaggacaaagctactgaaaattttattataaaagaaagcatagaattgtaaggaaattgttatagcatatttagtttatctaagagtgttacatgttctcctttagtcagcaggagtacagctttttgcctatctaaaggattcctagattaatacaaatatttggtctatggttttgcccaaagaaattgctgtttgctaagtgacgaaaatgaaattggtcgcacatcatctagaaaagatgcaacccatgtactttttaaatgctttgtaaattgctattgctaattgaggacagatgcttctatggacattggttaggttaaattatttaagcaatccagaaattgtagatttagcaacaggatgtacctgcccaggtatcttagcttgctattgatctcatcgaaaggcactggcagattaaaccatttttgatttttagcaaccgaaaaagtctcttctactttctttggcttgaaaactttacacattccttgggtggtaaactaaatgatagctattctttaagctactatttcattggttttctgaaatcttttgttttttactcagtcttatcatttagcccctcatttttcaatc

SEQ ID NO: 762 - DNA, 896 bp, Homo sapiens
agtaaatgactcatatataaaatatatgtgaatataactaagttatatataaataatgcaagctgaattaaacatgcaattttcagctattaaatttattatgcatctctctgtggtctcataataaatgacacagttcagttcataattttttctagctattaggtcttggttctgattacaaatcatttgtcctctcactttttgaggttactatggtacactaacattttatttagatttggtcacagtccagatattaaacaatgtttttctacccttgtcacgaaagattctccattttatttgaattgccttatcttagtcattgtaaatctttgtttgttgaataccccatcatgtgttaagttccttatagttccactttatgggttgattagaaatctgtgctgacatttaaacttatcctagacaatttgctttaataatggtaagtctcagattactgctgcattttctgtatagttccactgtggtcccatgccaagatgtagtgacttcactgctcaaattcttctgatgtgggtttattaaatgatatgattgcaatgaagtattgtccagctcactttctctggccgtgatagatgatggtaatacttgccctctcgttaagttgaacatttttctagtatggactagacactcctgtccgagtcttgcttttaatcttttcttttctgatcactagcttactgcactatactttctccaaatatgttatcttgtgatttgcaattgcaagcaggaagactaatactagaagataaatgccttagaaaacagtgttttgttttcttctaatattcattaatatcttctgcttcgttctctcataattttattattgctgtatctggctgaaattctgcctg

SEQ ID NO: 763 - DNA, 799 bp, Homo sapiens
taccaaatatattgactatagcttaattgtgtttttaaaatttttacttgaaatattaaggaaggactaatttattggacttaagtctaatttattggacttaatgcatgcaattttaaatttcctaccacatttctttagaatttttgtttagtctattttattcaaccttttcctatttctgtctctttatatagctgatttttaccttcagaattaaacgtggttcatataggacagcaaggtcatatattctaaaacctgttgtcttccttttgcctgtttttaccacattatcatttttccatatgtagcacattatcaaggtgttactcagtgatggttgatcagggaagttcggtgtaaaagatcaccttatgaaagcagaaatagtgctgtgaatgtcaaattactatcaaaatatttgtttcttcatatgtatttgtattaataattataagttgaattttattgtatctacactgataatatatacatcatagttctagtagtttgtgatatttcatggttgaatgagtgaaaataatgtcatatttgaaaataagatttgttatagttaattaaactgagttctaatttaggcatctcattagtgacgttatttgagaggcttactttacttgatatgtgagggctaattattatggttggtgttaagtaaaagataagaaagatatatattatcattctttaaaaattttagaatgtaaaatgggtaataccagaatcctgagtccgagacacttattgttagaagctgtgtagggctttctagggt

SEQ ID NO: 764 - DNA, 171 bp, Homo sapiens
aagacacgtgtaaaccaatgatctggttacttgcaatgtataaataacacaagggttaatttaaaaaataatacatgaaagcacacttttctagaattttcatattaatctgttgactttcagagataaacaagattatggggattatttaccttaaatgcagatgcctat

SEQ ID NO: 765 - DNA, 350 bp, Homo sapiens
tattttttttttctaaagtacaacaatgcttccttctatagaaatcacagttttctaaatattgaactggtctttgatcagtgccagttttattactttcacgtttacttttacaaaagaagttattttagaagcaaaatatttgtgattgattttctttattttgacttctgaggggaaaatgttgtttggaatagtttcctgagatacaccttcaataaaaataagcattccagtcctgtatggaacatattccatttggatagtttctcagttatcaagagtctttataaatggtcagttccctcctgctaggaagtagaagggatttattattttaaattggagac

SEQ ID NO: 766 - DNA, 969 bp, Homo sapiens
ggcagagctaaaaactggctgtacatagagattccagtaaaatttcaatattcttcagctgccaaattccttaagaaaatatacttaaaaccaaatacttgctagagctagttgaagtcaaaaggcagaccctgtggaatgatccagtgcgttactcaatgagtatttcggcatttaagtctggggaaagagacgaaatgagtggttatgtagcaatcacagtaaattaaaaggaaaacaacctggggaattagacaaattgctgtacatttagaaattacatatacaataagattattttttaaataattattgtctgggctttacatcctgcttaatatttaaataatctgagccaaatgtaacagtggcccattgaacaaaaccctcaacgtttttggatttggtttccagggtatacaatacaacctttttgccatctggcatttcattcgggaatatagcctttgcttgaaaaggagaaatatcacaagctaaaattatagttaatatagggtaaactgcagtaacatctgtgcatatgacaacttatatttagttgcaccaaaacttctttggaattctaaagacggttttgaaattttgtgagtttgtagactaaaataacccttattttacaagcacatttgttttctcatttgtattctcccatttcaataaagtatatataggcaatcagctacagatttattttgaaaccttttttggaatattgttctttctagtcttgaggttggcacttagtttttttgtgggtttgccgttgcctttttgaaatggctatctgcactcatccccattgccaaataccctgtgagttttcatagtaacgagacacagctgtcctttatttcctccctcgttagtctgagattacttattacactatttcatgtcacttttctgttttattcatgtacttaatatttgttcatattggcatatagt

SEQ ID NO: 767 - DNA, 495 bp, Homo sapiens
atttggaaaatatcttactatagagccctttttcttaattgtgagttatgatcttttttctcattttcaatacataccatggtctgatatctttaccactgtcacttctaatccataagaagtgaagaaacctgattaagataatggcaagaaagctggctgatatactgtatgatacatacattgatacctgttatgatttaaaaaattaatccagctcttagttaaaattttggatgccatttgtatttatcagacttccataaaccactacctaccattctatggtcatgttatcttattaacaatgaaaaaaaggaagttactgtttcaccagtttcctatttttatatattgatttcctattcaccatattaattgctagccaggctgtcttcccttccaaatcatctatgcctttctaaacacaatataatctgttttatgtcaatatcacattcttagacatgcattcaattatgccatgaatgatgt

SEQ ID NO: 768 - DNA, 174 bp, Homo sapiens
ttttatattcttgtcctgtttactatgttagaatgtgataatattgaatactattcgttttgaaaatctttattccctcagtatctttaaatttttcttccatatttgttcttcaaatctgactgtgccatttgctttctcttttttgcttgattctgtatacatatattatat

SEQ ID NO: 769 - DNA, 29 bp, Homo sapiens
tgacatgtcctgctttttaattttctttt

SEQ ID NO: 770 - DNA, 176 bp, Homo sapiens
tttctcttggattcaccctctctatttcattcacaaaacattcccttgcctttctcactgaattttttcttttcttttttttctggatttctgttttgttttgttttactgcctaaaaggctatcttttaattttagtctttctctactctgattcaaacactataccactgttca

SEQ ID NO: 771 - DNA, 161 bp, Homo sapiens
cttttacacagcattcaaaagatttatcaggaatcacattacttattataatcttttctcatttttctttcctttccttgtaccttgctgtttattttctccctaataaatgcaacactggttcctttgcctttccaacctttcatgtcaattaataactg

SEQ ID NO: 772 - DNA, 219 bp, Homo sapiens
cagaaatcaactgaagaaagcatgactcttgacttctttgtattaagatcctgaaatacaaagctacttcaaataagaattaaccactttgttataactgctatcactaagcactgtacatcaggcctacctattttactatatcctttccactgattactatactttcttttcaagtaaatctccaccaattgattgaaatcttcttaaagatatgat

SEQ ID NO: 773 - DNA, 419 bp, Homo sapiens
tgcttttgctcctttcttaatcataactttaaaatctctaattctagcctaatatttgaccttagataatcaataaatgctctttatatgttattgaagcgacaccaattccatttaactttagcaaccgatgtctttttttaactcattaaaagggttttacagttatctctttagatgacaatacaatctgattgctgtttcatgtatttatttaggtctaattaaacagtagcttgaagggtctttctagcttcctttcctaaccagagtctaattttaggaattaaatacttctacataaattgataattcattataaaccagcagaatgtcttttattcctctaaagtccgtattacttaccattgttttaatttacagagcaatggtaaagaaacaaatcatgttactggcct

SEQ ID NO: 774 - DNA, 86 bp, Homo sapiens
aaaccacttaaaaaaaaaccacgtacatttctatttaatcatgtccttcaataagaaaaatatttgtaatttttcagcaatattct

SEQ ID NO: 775 - DNA, 116 bp, Homo sapiens
tttttgcagtataattgaactttttctgggttttccttaccctgttgatccagtttcttgccttttgttctgtcatttcattatatcttatattccattactcctcatgagtaaag

SEQ ID NO: 776 - DNA, 1266 bp, Homo sapiens
gggttttggaaagggattaagttaaatgtatgtttaccatccactatatttagcaaaatctatagaaataattttaattgaaaagaaaagatgcaataaacatgaacatatgtaaaaaattcaagtgtcagtctcaaatgggatacatttctataaatcgtgattaaatttaattcatttttattgttattctggtaaagtctaatatattaagtagaagtagtttaactcagtatattttaggtactctatattattttaaacttatttgagtctatgtggggtgttccccataggttcattaaaattgtagctatacattttaaacctaataactatagaatttgatcatgtcatttgataatgttatgtttcttgttgctcattttaacattcttagtttttattcttaaataaaaggaattccttcaggtctacttttcttattatacaaatacagtacattgagtaaataaactaacacacataaattgaaaataacaatttcttgatctatggaatcccaatttaattatttctctatagagcctactttggagaccatattatataacaatttacaacccttttagttttaaaaactctggtctttaatatacaataactttttctgcggagtagaaaaagcaatcaggtaagtggcacattaaagaaaaatattttgacattttaaaaaagcttaattttaagcaatttcaggttatttgttctacagataccccagattccatccagctatgtagttttctttacttgcgagcacatggaaaatagatgctgagttgttagagtaagatatatttaacaggtagttttaaaaggaaatataatatttatttttagagggtcgagtttaggtattgaaattgaggtcctactacttcttctttttccaaatttctttgagttgataatcaataataaagcaaataagataatacttttataaatcaccaagcaagtttccagcaccctatattgtaagtatagtttctctgatacttgctgagtggagaaatacagttcacacaaaagacctaaacaggtttcctaattctaggtcttttaaaaggaaatgaatgcatctgagagatggagtcgagttcatttttctgggcagcagcatgaacgatgtggcctgctagtaaaacatgaaatgatgaatgtactgaaattcaggacaaattcattattttattgtctggggatagagatgatgtgagacagtaaataaaagaatatatt

SEQ ID NO: 777 - DNA, 124 bp, Homo sapiens
aaggggcagaattttgaataattttatttgaggaacagaaatgccccttttcctttccagctaagatggagaatactaacctgaatacatgcttcaaatagcattcattcaaggaaggcatgca

SEQ ID NO: 778 - DNA, 351 bp, Homo sapiens
gtttcccctaacaagacaaatcctagttctattgcatgataaaaattgcatgatgcaattttgaaataattgtttttattagtaaagcactctgaaaaacaaatcaatgtaaaatctatctatgcctaatgaatttttttccaaaaaccttaaatggttaaggtgaacaagaggttaggaacatgattcctatatggcggaagtaaatgtataactaatgttttaacctaaacagaacgaaaacttcatctagcacatagtaaatagtaatttttttggttgatgataatgaaatggagaaaagatagaaaaatcaagttgacatagtagaaatattattaattcatttag

SEQ ID NO: 779 - DNA, 102 bp, Homo sapiens
ggctttactctgttgcccaggctggagtgcagtggtgaaattatacctcactgcagccttgaactcctgggctcaagtgatcctcattctatagcctcctga

SEQ ID NO: 780 - DNA, 106 bp, Homo sapiens
tccattctatttaaaatatataactagatatctcacaaatgcttcaaactcatcagttttcacctataccatatttactccttctttgaaattcagtttcttgcaa

SEQ ID NO: 781 - DNA, 50 bp, Homo sapiens
aactgacttacttatgtttctttatctccatgcccaatgatactgttttt

SEQ ID NO: 782 - DNA, 618 bp, Homo sapiens
gcttgttttactctattttaccaagctgttttaccagccccatctctaccactctcctaccaatttcccagtttgtttccagaaagatctttgtaaaatacaaatctgataataccaataattaacaaatgttttgtctttcatcatctgcaggatgcaactgaaacctcttgagaggacatacacatcttttgaccctgctgctgtctacatttctgacccctgtaattgccaaatatgcatatattcaagttatactaaaatattttataggttgaaaccttatgttttatatgttaatcagtctgccaagagacatacctgttctctttttcactcctggctacctcttccctgtccttcagaatgaaagtttctcccccataggaaactcttctcattactacccctctctttcggacttaagtacttgcctactttattcctctagcaacccatatatagctctaccacaggataaacactgtgccatcattgtttgctcactaattctaatgcctatctagaatgtggattccttggactcatgatgaatgtctgttcttatttgtttgcttatactgctttgagtagaaaataagtttttcccactctctt

SEQ ID NO: 783 - DNA, 249 bp, Homo sapiens
gtttcccctaacaaaacaaatcctagttctattgaatgataaaaaatttaaattctaggtttcaaagctcctaggcaaagagtgtagaaaataatcccttcattataatgaacaagtaaaataagcaggtcttcagtggtggaattttggggttatttaagagatgctcataaattagaggcctgcttggatttgacaaatattatacataaatgcatagttaatgcattctttttggatacttaactc

SEQ ID NO: 784 - DNA, 208 bp, Homo sapiens
tgcataataagagtaagataaaaagatgagaaatatgtttttaagcattagattgtggagagcttgaatgtcatattgaagaatttgacttttaattattgaaggatgataaaatacattaagtaagagattgatttttaaatttgtttccttgctattttttactgaatggaattttagtgactggataaaagttgcatgagagtta

SEQ ID NO: 785 - DNA, 811 bp, Homo sapiens
gatactttgaaatatggctttcagcatgaaagagaatgagggaatagaaatacagattttacagtcatcaaaaatggactttggaaaatagcattactcaaaatgagactggcacggttctatattattgtaggattataaataggctcaatgatattgtcaaagaaattaaatagcatgagaaatgctcctattagaataagtaggggaatgtatcctaagccggatatgtaatatgtatttaacaattgtctttcagttcactggaatactttgaaatggaaattttgtttcccctgacaaaacaaatcctagttctagtgcatgatacaagtttgaattctaggttcaaagttcctaagcaaagagtattagaaaactatcttcattataattaacaagtaaaataagcaggtgttgaaattacagtttctcaagcttaagaaataaatcaggatggggccattaaattgtcttttatggagataaatgcattatttagtaacacaggaaaatggctacataatgtctgcctccttttgatctaaatcacatacagtcagtgtggataataaaaatttatttgtataagtaaattgtacagtactccaggcctacttcgtttctagttggtcttcgtattaaacagaatgtagatatttaaagatccaatgaaaatataacaacaggattttctattctaagtatcaaagtaaccactgaaggaagaaatcagattttgatttattctttttgtaagtagacatttaatgatcaattcaaaggttagtaataagagacccagaaacca

SEQ ID NO: 786 - DNA, 615 bp, Homo sapiens
agacagggtttcaccatgttggccaggctggtcttgaactcctgacctcatgatcagcctgcctcggcctcccaaagtgctgagatcacaggcatgagccaccgtgcccagccttgcagagaaattttaagcagtgcttcctcaagaatgttgatacaatagcctggagtgtttatagcaaaggtcagaaaaaacttttgtaatattccacataatacctgcctagaagccagggattgattgtaacaccagcaccaaccctctagatggaaaccaaagtttttacctgttataataatagcacttgtggagagataacataaaataaatgcaacaaacgacaaaaatgaaattgtaaaaagattaaaaaatttttacatgacaaaagcatgtaaatatatctaaaaagtacatgtctaatgtttttctattcctaatctatttgttatcattatataacaaactagtatgttttacagaatattatgaaattacagaaaagcataaagaataaaagtagtcactcataacccaatattaaaaggaaagctctataaatatttaggtatataaatatgtatcacatactaaacatatgtatctatgaatgtatac

SEQ ID NO: 787 - DNA, 386 bp, Homo sapiens
gaatcaccaatgttatgagcatttttctgtgtaactagagaatgcatttatctgcagagaggtcagttttatggctccttcataatttatttcttaatcatgagaaattataatataaaattattggatgtcaggcagtgatatagtagtatacggaagttatcaaataaacagtccctagaactgaacaaatatattaaaaccaaaatgaagataaaatgattataggatgtttttatgcaacagtaattagataaagttggtgggaggagggaggataggtgcagagagcttaggtaaggaaggactttcaaagtcacacttactgaatacagattttatcctgagggcatgcttatatacagaagcatactttaataaaatca

SEQ ID NO: 788 - DNA, 1068 bp, Homo sapiens
aaggaatagtgatgtagagaatggaaagaaaggacaagatttgcttcagtagcacatatactaaaattggaacaatatagaaaagattagcatgaacctttaaaaataaaaaaaaaaacagtactaggagaattgtttcaaatagcagttacatacctgagtcattctgatcagagaaaacaaaacaaaacaaacaacaaacattacctagattaggaacagaaaatttgaagctatggtaacactctcaactcaaaactgtggtggctacttggagtataagaaatgattctgtgttgcaattctgaatagataatagtgcatttaactttgcaagagtcatctgtaacatcagagccttgagcaagaataagctttcttacaaataaaaggagtaaatagcaaaatttttggaccacatccgagggaatgtccacagataggagggcaagaggatgaaatataaccaaggagagaagagagaaaagcaatagcagctggatttgggcaacagtatcaaattatggataggaataaaataatgagaactggaaaacctgttgcacatgaaaaaaacttcttggaggattttcaagaaggcagtttcctgtaatatggaagactagagttggtccacagattaaggagaataatgaatttccttatatgtcgtcactcagactaaaataatgactaaaggatggaaagtggagagtagctatataagtcagtaggtgggagttgtttttaaaaaggagttaatgaatacatttgaaaagaaagatattagccaggagaaacccttccttctccattcacttttttttttattgaaatttaccttgagaatctggaacccatatttcacttaacttttgaccctatagccatctctaggatatatggaagacagaatacagagtgagtgaggttagcagaggaaaaagcaggcacattcatactatctgcaaggagctacacatttatatatcacaccattctggaaatttcctggacatttttttggtctcctatgaccactccaatttattttaaaatgtttttgaa

SEQ ID NO: 789 - DNA, 450 bp, Homo sapiens
ctctgtagaatatctttacatttaatacaatataattaataactattacctgcatgatgaaatacaggctttaggaagaaatcagattaaagaccatttagtaatctatacttagcgtaaaacattcatctaatctcagtgctactgaaaatgggtgtatgttttaatattaaatcaccttttaccaaccatactaagaaaagataaatattattttgttgtagaagaacagaccaacacagtaagagatcatattattaaaggcttgggagtatgatccatttacattatgatttctgattaaatcataactaaatccacttatatgtaatgctgagtagaatactgataatcaataattataattactgtgtttccaaaaaccaaaatatttgtttttttaaaaaacattattttctgtcatccaatgagcaagtctgaccaggctat

SEQ ID NO: 790 - DNA, 586 bp, Homo sapiens
cctctcccagggcatttcttaatgctttgaggaaagaagtattttatggactctcagggttgggagagtaggttgcttctaatagatacattccaacataaccactttggtagtctattaactcatttcttaatcccatgcttttgaagttgctgcatttcaatttcattgattataagcaatttttgtttccaggctttaattaatcatctgactgacaattcataaatagtaatgccattcacaggtgctgaagccaagacattaaaacctagatccttagtgggtacaacactgttcatgaattcagcctcatcaagtcatgtatctcttttccatatagacctacatctttagaatgcactccacaaatactcctcaagattttcctgacataaaagcttcagtcttggaacatttttggcgtaactgtatctcttgccaaacagctcaatatctgtttgagttaagcagaattctaagtctttatagagacctagagtcaatacttgatgtagagacattgtcctaaggataatttgcatcagtttatgatgtaaccttcttagagttatctatgaaaagt

SEQ ID NO: 791 - DNA, 581 bp, Homo sapiens
caaagatctggttccctagggaaggggaagtgctgccttgtccagtaagaaaatgtggaagttcaaagttctcaagctcttccatgagtatccaaacatcctatctcatatctcagggtctcccactagtgctcctacctggcatggtcacacacatagttggtcctataaatctgtcacttctgcaatccgacctaaccttcatcttcagtcatatttgcctgctgtttttgtcaagtacgtttctgctttcattactgtagattttgcttctcatatttcctatgtaaactctctagagatataagaagcagccagcagactccacatctttataatcaataccattggtatcattaggaagttgatctttcaactccctttctcttacctacacttcaacccatgccacaacagatgataatttgagtgaatcttatgtcattctttgacatgtatttcccatggttctttcctctatccaatcctctataagtaaggaatttattcatacttatttactcttcaacgaacccaatcttaaaatactatttcaagtgtttgttaatgagaaccaccat

SEQ ID NO: 792 - DNA, 162 bp, Homo sapiens
atacctcatatatcatcaattatgatgactgcttgaaatgtttacaattttatggctaaaaacacagtttctttttaaaagaggaaagaattaatcatattttaatagttgagctgttttcaaaaacagcttaatcaaacatttactacctagaatatacat

SEQ ID NO: 793 - DNA, 1490 bp, Homo sapiens
aggttattacactaataggtataatattgggaaatgttttatagcaattatctcttcccatatatattttatagttatttattgagcatcttttatgagatggggaatttaataagaatgatgataaatatgaaggaggctataactcagatcttgttcatgagatgttacagagtcagtctgctggaagcactgagtatatatgcagaacaggcatggaaggccatgaggtggttgtgttgtaacctgccagcattgtatcataaaagctttcagtgaccaaaaataattctagtttccaggatgcaggaaattagacagtttatagggcagcaagtctcagaaaactagacagtgtgtttattgatgggcacaactactcacagaacaagtggaataaaatcaagagcctagtatgtacttgaaggtgtgaataaagtttgagcttcccaaaagacactggtaatttaaaaaaggagacaacccaaaattgactggcatttgaagaaattttggacagtgtactaacatcactagagagtctagcctacctttgttcatcttgttatcccctctgtcactttcatgactttgaggttacccctaattaacaaaattaaccagaatgtaaaatgaatatgcccataattttacatgcactccttcctcatttccttaccccagatctttacaaaggatgctgtgtattcgccctaaactatcattgattctggaaaatacttaaaagcataaataaaaaatactgaatgtgaaagctatgtgtgttttattttccaccatgtggtattaggttgggtgcttgcagatgaagaaaaatgaaattcttttgcaatatctatcctctcattgatttagtaaaaatagaaaaaggcataggtctccatgatataaatttgatgataaacaataagagcagactcctttccttttaaaatttatttttcacaattggctcccagatttactaaatgtacactattgttgtgtgttctgtgcttaattttctaatatccatttcacctccagtgattattacaggcctatcctcacatgactatttcattgccagtgattggcacatgacccagccaggttgggcacatgatataattgttatcaatgagaactaaagagaaatctgtatgggattctgagaaagttttacgtgtttctgtaaaagggagttgaaatatgtttatacatctttctcatatggtcattgataaaaacatatggtaagctgggaagttccatgaccatctgactacaaacctggtaaaatgacaacataaagagaagcacagaaccaaaaggaacatagagaagtgggaacaacataccagaaaacagatcctgcttagatctccatcacctgtaatgtcttttatatttgtgtttatatatttttcattatttaaccttattttagtcagaattttctgctaccagcaaatttacccacccaaaac

SEQ ID NO: 794 - DNA, 353 bp, Homo sapiens
ggaccctagtggggactggacatcatactcccttgtggcacaatttctgctgtgtatttaaagacatgtccaatacatagttaagaacagctaactgtataattatccatactacacacactgattcaccacaaaacccaaggaaaacttactcataaacttgtcataagaagataagcaaaataatttggcttcactaatgcccaacttttaaaagtttcctaggtagttgttttaaataggatttggggaactgtgaaaaattaatttgattttttacaaccagcagtttgcaaaaagctccatttacctctttatatcagttcatccctcattttatttatttatttatt

SEQ ID NO: 795 - DNA, 768 bp, Homo sapiens
gaaccaccatgctcagccagttcattcctttaaaaacggccagaaagctctctaagagacttgatatgaaatttcttacacttcaccccagccaacccccaggaaacagcagctctctgctgcaaataccaaggcgccaagagcagcctctcaggcaacccagagcaaaaaccaagtgcttttccaaaccaagggcaggcaactgatttgttaatttcccactgtgaaattcatcagaaaacctctcactaataaaactccacacaacacctgaactaactctctttatcacggcagagtccttaactgcctaccttgttcctgttgttaagtccggttccccaaagataagtaaaaccaacttgcccgatccatggccatgcatctgttctcagacataagagggattacagcatcaaatcacttatgagaaaaaaacattcataacaactcccacagaggaaaatatggcagaaccggaaacaaattcatcttcattagtgcttcttacccagatttctaaggactgggaagcatcccagtggtggttactggaggtgaccagccatgaacaaagcgcctggcacttgaatggcagccagcacagtgaaataaaacggacgatagccattaatcatccaactgtgcagaaaaagttagcattctatctagagctgtgttttactgatgtttggtagtttttttcttttgtactatgactcacaatttcataaaaacacttcccttacatagaggtgatgcaatcct

SEQ ID NO: 796 - DNA, 146 bp, Homo sapiens
gatgattctttacattgttatgtgcaacccacaaaactgattatttgatctactcaaggatcttactgtgtagtctgaaaaccacttcactaaaaaatgcttgggtgtcatcagcaaccagtgccttcccttcaaaagatgactca

SEQ ID NO: 797 - DNA, 736 bp, Homo sapiens
tgattcatttcttcatactaataatgtgagactatcccttcaattaggtgccatggttttctttatatcctccaaatttaaagctaccatatggaagtgggaaatgtgaggccaatttagtttcattcttctgaatcaatgtcactcagcttcagtaacacgtaggatcactggctagttttgatctgagacttttaggtagaatacatgtaaactgacagttcaaggaggtctctaaaacctaaggcattccttcaggcaggtgtaaaatacttagaattcacttagaaagtaaacacttaattaaaaaatactgtatgaaaataagtgaaggcaagtttccttcagacttgggacagaccacactaccctacacaggacatttgtgacgtgggtgttgggcgaggtatgtggcaatactgaggggcatgctactgtccatctggcaagatgaggagacaagggttgacatggaaaaacaaaattctgccctggggcagatgaaaagtactgcatgaggcagctagagttcagaaggggaagggctggctccagctgggtccacctggcctttgatgaaaggacaagcaggaccaccctggcagaccacaccctgcttgcgcagcaggtccaggaagactgtggtcgcttccctgatgtccttcacccaggtgcctgagagtgacatgctgtttcataccaagactctccgagccttcttttctcagagtccctc

SEQ ID NO: 798 - DNA, 97 bp, Homo sapiens
acccgagtccctctttacgactaattttcctttctacttttctgcagccactctctcacgcccctgtcctgtaaatggcccagtagctctgtacgtg

SEQ ID NO: 799 - DNA, 76 bp, Homo sapiens
atagtcacaacatacagctgaaaggttttaaaaaatgaactgtacatattaaatcactttgtattctcacttggat

SEQ ID NO: 800 - DNA, 26 bp, Homo sapiens
ggatttgttattatttttaatctctc

SEQ ID NO: 801 - DNA, 340 bp, Homo sapiens
gccctaaactcatttgtcttctcattggcatacttttctagagaacagggaacacattttcatgcaaatggctccccactttacgaaagtggttgaaggagagtggatgtacatcctttcctttctagacagctcctaaagtcagtcagttcacataaaatatacctgaaaacacaccaattcccactgtgacatagggaagcctggcaagattcttcatcaaagcaaggagcttctgacgtgagcaagtctagctctccactacatcagccaagtgaatatctgaaagtacacgccccctttcagagcttgcacgaacaattctattattatcctatta

SEQ ID NO: 802 - DNA, 625 bp, Homo sapiens
tacaaccagaaagaaagccaaagcctcaccgcactgcctctaggcacagggcaatttacccaggaaagttaggccaggaagtaaacttttgtaaccaaaatagcatttttaatttacaagaccttacatctacttactaaggaaatgttaagggaaaaaaatcacattaattcctctcgagtacagctagatggccataaatgttgtcctgcttaaaacacaggacttcagactgcctgcatgtagtcagaattcctgccatccatcaaacagccaggccaggtctgcctctctccatgtagggacactgtccaggggctaaaaggttgaaaatggcttttttccactaggaaggctgtggggacataagctgacaactaccctacatggaacaggcaaccccgtcatgcaagcaggcctctctcccaaaggcacctccatccctgctgtcatgtggcacagatgagcacacctactacgtcacaatgcagtgtagccacgccagactggaccaaggacacactcttagccttctcttctctccaaattcactttattatctttaagccacacatccgtggttgggaaggtgtccttgattcttcaaaaatcaaaaggcatctcc

SEQ ID NO: 803 - DNA, 582 bp, Homo sapiens
gctttgtaaaaggcatttctgatatgcacgtttaagtttctggagaaaacaaaaccctttgccaagttcttactccagtgtgtttaaatttcacattgttaagacgttcaggtttcttgtcagcattgctcaaagctgcccatggtcagcagcttaatttttgaagaattgaggacaccttcccaaccactgatgtgtggcttaaagataatgaagtgaatctgcagagaacagcgaggctaagagcatgcccttggtccagtctgttgtgaacagtgctgctcctggggtccacactgcagttatgcactgtagccctcacagagccccagggcacctttcacagtgccacagagaccagttctgtcaccaagcagcacagggtgaaagctcctcagacttctcaagctgttctgacagagaaaaaccaaaaatctttacttagactatctgtttccacactttcttcgttagaggagctgattttttttttgtgactgaactgaaagtatagtgggccctgggtgaaatagaaagatgaaataggagaaaagactattttcgtgggttctcaaacttgtg

SEQ ID NO: 804 - DNA, 177 bp, Homo sapiens
atgtatttgtatgtgcatgtgtgtgtgagtgtgcatgtgtgtgaatatctgtatatgcctaagtgcatgtactgagtcaggactgagaaccattgctcaaggccatgcatgcacctagatggcctcaagttcctcaaacacaacccccactagccccgaaagcctaaaatccctgac

SEQ ID NO: 805 - DNA, 694 bp, Homo sapiens
aaatgtttgaaaagatcaaatgaactgtaccaaagtcagaggaaagctttttgtttattgtcagagtgcttttaggaatcccgcgtttactgcctgagccacagaaatgtaatactgaagggggagagagatgaggactatgaagcaaacacacacaaggccaatttagatatgagagtggggatttatgtgtttttataatactggagtgggtataaacagagctatccaccctgcgagagaataaaagatcctcattatgttcataaagggattttgcagattatttcctgctttaaaggaaataatcatgtttcctagaacacatctataatcttcatcatatacaaataagcaatagactccccttcttcactctccagctggacgcttgggcaagggtgttttgattttctctgattagccaggaaagggggtgtgggggaagccaccctcaccctctagtccagcccagcaatcccactgcatgcacctgcagagccccaggggggcagtgtcgctcgagccggggactcctttccaaagatcgctcccggcatccatagcgctgcatcgagggctccgggctccgagggctccgaaggccggggagtgggaccagctcccacacaggagacgcagctcagggcttctacatttctaggaatgctaaaaacccaattttcttaattcc

SEQ ID NO: 806 - DNA, 181 bp, Homo sapiens
cctgcacttcccgtccttggcctctgttctcgaggcggggccaggactctccacgctgccggagagcccagacagtgtctgagattgatggtcaataacacagcaaggtcttaggatttcaaaaggatgggagggaggtccaccaaatgacacattttctatgactggctttaaaaaaaaa

SEQ ID NO: 807 - DNA, 138 bp, Homo sapiens
ccaaaacagaaatgatcaactttccccaaggcaactcctccccattagaggtaccatcctccaccaaactactcaagcaagaaagctggggctcaatttcacttctttctcttccacattccattatcaatccccata

SEQ ID NO: 808 - DNA, 618 bp, Homo sapiens
cagctcagccagttgaacttccacacccacacatcttacagtcgattgttccctaatttatttttccatttctgcacttgttttctgaagaaaacaagttccttcagaactcagctcaagcttttccctccctttatttagcttagctgtgctttctccatgccccaaaatcaccctatgccaatttgtacctagcactctccatactgggctatacttactggtttgcttgtctcactaaattgactacaaatacttaacagagggcgtctctttttttgtttgccagatgcctaacaccatgcactgtataaacacataagcagaatatttagccagcaggatattaatgcacaatataaatgatccaaaactataaaatgtacagagaagaatgaagtttggttttgtctgagcattttccatatacatatgtatttgatttaaaaaatttcttcataccattcaatcaagtgaaactataggtaaagatatatttaaagcatgagtcttcttttctcctcttgtaatgattttccaaagaataaaatacacttccactctgccacagaggacaacaaccctcttctgacactgataaatacaaggaaaattatt

SEQ ID NO: 809 - DNA, 312 bp, Homo sapiens
accaaactgatgacaaaacctgacctaagagctatataaagtctttatttatcacaccatcagggctacaattcaacacttttttcaataatctttctgcagtttcattctaaaatctggttagtagccaaaataagaaaaaagaactacttgtgatttgtccttaactgtctggtcctatgctctcataatactctaaggcttcttgatttatattcttccattccatacctacctttaactcagaattgggttttctgtgtatataggaatggcatataaactatttttttcagacttattgaggtatca

SEQ ID NO: 810 - DNA, 556 bp, Homo sapiens
attgtgattttgacttgcatagtcataattttgtgtctgactccaaaaccctctaaagactttctttacccagctaaattctatttaaaacattgctaaaataaaccacgaaaaatgaaattacttctagtgcttttgtgttttgagatcatgtcagccatctttgacaacaaaactgtttcctcaattgctctgctctttaaaagaacttcaagtttctctctctgttaattgatgtcttatttaaaaacaacgttttctaggtctaagctaagtccctatgcaggaactccaactgtgcatcaggaaaaattccaaatagccttaaaattaaaacacaaacaaaaccataaagcaataaaagattttttcttataactttagaatgtatagcttatgaaatttagaaatacttttaaataataaatgtgatcacagaaaagtcaaaggtttctgcaaagcacaaaccaccataagcaaagttaaagacagaataacttggggaaaatgtacgtactaatttcgctaatacataataaatttctacaaccaatta

SEQ ID NO: 811 - DNA, 776 bp, Homo sapiens
taaaaagagagccactggacacaattatatctgatgtatctatgtatatatattttttaatgtttcagatactattttctaaaatatctcttcaataaaatctaactttcgaacatgaatgttttcttgaactaaacttctagaaagaagaattaaggtaatatattaaaagtgagagaaataatatagctttcaaatgaactactcagagaaagttcccttcaaactgagggtttttcatttgctcttctgtattctggatcaaattggctccttacattataagtttccactccctcttcaggactaattaagagtcttttgacacactcagttttaggataagcattcattctggaatattatcctgagcattaacaatagaaagagctctaaatttgagcatgcctgttatttgactgatgattccattcatttgctgaagtaatccattttagccatttaacctatgagattagaggcattttgcatggttaagaggttctcctatctttctggcaaatctagtttttggctgacttgtcttcctcttttacctgtttttcaactgctggtattcccaaagatccattttctcactctttgtaatgccccaggtgatcctgtttactttgaaagtacactctttattgtatatgaggctgacttctagtcactattatatataaggctgacttctatgacccctcaagcacatgtccaaaggtaaattatttctctccaaaatgtcttttccacctcctgaattatagaat

SEQ ID NO: 812 - DNA, 430 bp, Homo sapiens
acctacaccatgctccaggaactggctcctcttcaccttttcatctaatctctcatcacttccttgaaccttccatccacttctgaaaggaaccatgctatttgttctctccacactattaatatcacccaggacattcccttcaccctgaacacccttcccctctttttcccccatggcatatctccacttccatctcccaccatttagtgagctattactatctctcaatattctactcaaatgtaacctcccttgttaagcatatatggctgtaagcagtatctgctgaaggcaagtctttcccccactaaactgctggagcaataaggtcaaacaaaacagaggcagatttctcatctctcatctcatccacacactgagcaaaacatctggtatatgagcattcagtaaactgtggttgaatcat

SEQ ID NO: 813 - DNA, 1024 bp, Homo sapiens
ttaaataaattgtggttgaattaaatctaactgaataatatatgtttgcttttaaaggttcagtagcatagtgagttaaagaagaaatgtcccaaagattagaggttgggtattttaaaaagtaaaagaaaagattttatgcttcagtgttagccactgggaaaaaaagaaaaaagaaacaggattttttttttaaatatgatgacaaatgttcaagaaagagagctgaaaatgatgtgtctgaagtaaagagtggggatgagaagggaagaatagcaagattaatagatgcctcccaggagttctagatgtaataacctttcttcttttgccaaaatccaagtaggatatcaggactattgccttatcttttcacttttctggagtcacttggaatttatagatacagagtcacttctagactgcactaacaccctataatgtgttaatcagccttctattctattccatttccaattccacacgtgtcattacttgcttgtaatcccaatccaagcgctcaactttttgatactggggaaaaaagtacctttggagatcaatttctgagtaatcctcctctcgtattgcactttgaaactatggctgcacaggtcagctatttatgtagaaaagggttcctcctctattgtcactaggaccttgaattagcctctctttctagaacacagaactcaggaaaggaagagtagcaggattctcacatcattcctattttccttctctggggccttcctgtctatctgaaaaggttaccctaagtggttgcttcccttttctcatcattttcttgctgtctaattagtatacatagtcctggtgtgattgtctctgcaaccctggcacctgcttcatgtcaaactgatttatgtttatcgactgtttcaaagaatttatgttttcttttttctcatctgcctcctccttctgactccctcctatttgcactttcgctcactctctctctccctgttcctgcccaacccacacacacacacacaca

SEQ ID NO: 814 - DNA, 825 bp, Homo sapiens
acacacacacacacacagttactcacatatacacagaattcatacatcaaatcgccatcacttttctttcccaagaatttactaatgttcacaaagtacacatttacatttaagatggctccagactctcaagacagatgcactttcaaacccaaacatacttttgggagaaagactattgccatcaagagaaatgcctaagagataaacacctctgagaactacttggtaagaaaaaagttcaagccaaaataagagaaaactctctttccttcttcgcacaccgagaattgcatactggcctcttctaaaatgcaatgtgtgcgctgaagtgatagaagcaaaagatttagattcacagtgggatgagatatctgtagcttaataaaagccagcagagcaattgcagagaaataatagagatgccagagggagatggatgtacaaagtactttcaaaaacagcttgactctgctcttgtaaatacgagtctagccatgtgcttggtcaatatatgctagatagaactcagtataactccttataattttaaaagatctttctcttatcctaagaatttctaacatagtatttcaccataccattcttacccaacttatcaccagattacattccaaatatatacactttttgttcgttttgttatattttccttcaatttccagaatttaaagtgcttataaaatttatttctgaatttctattataaatctcatctatattatatctacacacatgagcaaacacaattttgcaccaactcacccaattcaaaactaatgagaattaaacactgtatttttc

SEQ ID NO: 815 - DNA, 230 bp, Homo sapiens
cttaacaagtatgtatttttaattctctgtaaacacaagcacatatgacataaagggatttaagcaaatctgcttacacagtgcttaccaacaaaagttcttgacattaatacatcaactaagccaattgtaataaaataggagatcaaaatgaaataaagcatagaactggcaggaagcaaattaagacactttatccttggtactctaaaacaaacaatggatttaga

SEQ ID NO: 816 - DNA, 105 bp, Homo sapiens
gggtatcaggaggcaggggtcgaggaggcaccctggagtctgcctatcacagatggaacagttataaggagcctggttcatttaatttttttaacttttaagttc

SEQ ID NO: 817 - DNA, 312 bp, Homo sapiens
ccggtaagaaagaatatgtccagtctcactggattccccagagtttcatgaataaaatattaaaataactcagaaaagtagtctaggcattcatatagaagaacgtttaatagctctttacagcaggaaaataaaccaaaaaaaaagtgaaaatcttcagagttttatcaaagacagataaataaataagttatataatgcaaatagcataaaaagcagctaaagatattatatacggaagctaaatgaaagccaatggcatatgtgggagactgtaacacagtcccatccgtgccacaatttactgtgggt

SEQ ID NO: 818 - DNA, 689 bp, Homo sapiens
taaaatatggtatcagcaaaatgctgacaacatagtatagaattttccaagtaatggatcaataaaatgagaagtaacttagcatattccctacaattaaaatgcttgtttccagatgaaagtgtttctatgcattttatacccctcactctcatctctaacaacatagtttcttcttcctggaatgtcctctttggggttttggggggttatttaaaaactgctccttcccccaaaacctgaatttaggatacagtagaagtttcagagaaatcagccagagactaacaaatcccttttattctcattaatttactatcattgttgaaaagaaaggtttatgtgttacagtccaagaggcctaagatgaagcccagatctaagcttcccactcaagcccagggagacatggactgatacagcctttgcttctgagggtttctaccactaactttaaaacattgaagaaagcaggcctgagctgagctccttttccaaagccactagactaatacattactcctgctcacatggtggggagagacaccaagaatgttagtctaagaaaatttctgggagaaaacaagaggggagaaagtcttttgtgttttagaagcattaatctcttaagctccagtattttctcaacatcctaattacaaaacttattagtgttaccttataattta

SEQ ID NO: 819 - DNA, 1348 bp, Homo sapiens
ttttttaaagaaatcataaaataatttctgaaaaaatacaaaaaggagaattaccttgtatttaagctatttatgtctgtacctgtccctgccacactgtgactccagtttattaattttaaaattccctgtggtgcacagtacccacagaaaacaggcatttgggaaatgtgtgcaaattgaatatctgtgttctttgctaaaagttgttctttgcctatcaataaggaataactagagacaggtaacgtaattgctaaatggaaggcaaactggtagagtttcattataaataaaacttaggaaattctcaggttctcttaatgatagaaggccaaatgccccatgcctggagacctaaaactttaggcacatccttccccataagcaatggatttgtgcacggatgagctctaatttctgggagtacttgtggagatttatctttgatgggctagctccacaacagtataaatattgctgataaaatcatagttcatacatcaagaaagataaccgtttgtataccttgactaataaaacagatactaatctcctggatgatttgaatgtaacataatcaaaaatgcgtttttaatttactcctagattttctgaccctatagcttatttctacataaatactagcataagactgctttctaagactcaacctttaaacaaaactaattatacatccatttaaagatgaaaaatcatgcagtccttcacaataaaaagtgcatttctgatccaagagaaaacaactgcagtaatgaaaatccctaaacttactggagagtgtttctttccgagaattggttccaacttcatagaagtaagaggtgctgaggtcagagtgagcagaccgtgtgattcaaaagcgtgtatccaagcagcaaatgtactagaattgggaagtattcagcaaggaggtgtctccaggcaggtagggctccattccccaatcaggctaaatactggctttcagaaatccacttgacaactctgattgagatgagattgcagtctgtaaaaggtcaagaaaacttttatactctagctaccatgatcacaaaagtgccaaaaagcagggacaaagaatagggagtttgcagaaaagaagaaaatgtaatagccctgtctcctcccaagcatggtgaaaggtaaaatgtggctgagaaaaaaaatatttgtgtcaggcctagattctcagtctgaattgaaaacaatagcaatgagattgtcctatacaaaggcaacgcgtcagaggcaccctgcataggctgttgtatcttgttttgtaattccaagtaaaagctctgtttgggcatatttgctgtaggat

SEQ ID NO: 820 - DNA, 133 bp, Homo sapiens
ctcccaatcccaacacctcctgtcagttttacacacagggaagctaaaatccaaaagcgatgggacttgctctctggcttagctctgcatttgagctaaagtatgcctccagcctgcaagctcagctcccatg

SEQ ID NO: 821 - DNA, 743 bp, Homo sapiens
ttcctcattctttagcaacataaatgtataatgactcaccttgccagctcagttgggtccccttcataccttagcagaactttcattagtccttagagggtcacttaaccctctttctcattccccatcaaatcacttcaaattctcatttatcatatcaatccctctatgttcttgccaactcactccttttcatttttccttctaccgtgcaaaaaacttgccatacatcctatcaacccatctttttattttcttctgttttaccttctaaacatacctggccttgtccttttgctaaagagactggtccatccttttccatgctattcagaaccacattccatttttttcagccctctctattttcatatctcactgttcccttcttcctttcttccttcctatccatcagcctataaacttaaatttcattacaagaaaagttacaataattatattagttccctcaatttccatgaaaatatagctcttttccccttgttctcattttgtcttctggtttgttttttttactgtcaattgtctcctaagtacaagctgcagttggtcattgtcttctagtctgctttatcatctgccttcacactgtaaaggtgaaggtcctaagaacaccatagacctccttatgtccagactcaaaggcctcaatgaactcttcaccctcctggatctcatggcagcaacaacactgctggccacctgcccctccctaatgctct

SEQ ID NO: 822 - DNA, 114 bp, Homo sapiens
gtggaaatagattggagcatgaatctgttccacccctgggctgcaacataaaaccaccttccgtaaactgacataaaagtcttttcagacatgtaattacctccacaccaggga

SEQ ID NO: 823 - DNA, 472 bp, Homo sapiens
gactatatagtggaatgtagccaattgagactgatgcttttattgccctttcaattgttttcatgcataattgcactccttgtaacctacaattaaatgacaaagtatccaaaccaatcattctaataacaaaatatcaactttccattcagaagatttttggcagatcagcaatagtagaggtggaggagaactgggaatggagagtgtttaggcagagatggcctctgcccacagatgcagagtggcaccggagagcatccaaacacaccctgtcaaaactcccaaccctggatagggattccagaagaagctgcctcatgtcaatagaagggcacagaggaaggacccaatagtgacagtcaacttatcatcatgtatctcaaatattcaattaattttccattccatgcagtgcaacagagatttatgaagtgtcagctacatttcaggcagtgtgctagatctataa

SEQ ID NO: 824 - DNA, 290 bp, Homo sapiens
tgctaaatgaaagttagatattctaggaggcaatctcatgaagtaatccctctaactctgatatgataaccagggaagctgaacttacttaaactttgagataaggccaaatacaaggatgaaaaatatttgattattcaggataaggctcttctttcacattagtgtggcagtgtaacatcatacgctagccactgtgcatgtgatcactatcatcaatccctgcccacaggtggcttccaatagaagatggaaacaatgcaagtttatacaccaaatataagtaaaga

SEQ ID NO: 825 - DNA, 121 bp, Homo sapiens
acactctttacaaagttagatttaaaagcagattgcttaggacttaatgttggcatgctatcatcagctgtgaatcacagtgaaaagaaaaatcaactaattccaagaaggattgggtagc

SEQ ID NO: 826 - DNA, 1213 bp, Homo sapiens
gcacataacaaacttagacaggcagtatttatatggatttaataagattaaaactaggaaaacaaacagaaaaattaggtatatcctagttataccactgaagtattattttaaattatctatacactttaatgaaaaggtaatggcaagccaactatattaaataacaatttctaacatgttattctttgtagaaggtctgagatggcaagcaaaagggaaaaagaggattctaagctgacagaagttactgaagtctagaagcataattagccttcctgatttcctgttcttgttttaatgactagatcagaaataaaaattattaacgtaattatacaggataaagtgaaatgatgcatgtggcagcttgacaagcataattcatgacaaaacaataatttagaaaattatcttccataaacttttctgaaaattaaaagtatttatatacttccacttagcagtcattgttctattcattctttctcctaaagcaatgcatgagttatcttttcccaatttcatttttgacctagtttttatgtttatcacttattaagactactcattatcatcaaaattccccatgtttcatatttcctgaatcctcctatgctaccaaacagcgtgttatctgcagctgctccatctttgatgatgttctatggctcaactccctctaatctccccaaaatcaagctccctgaacctcccaaagctgtattcaaatgcatactacaaagaagctcaatcctattctttggattcttagtgacaacattcttttaccctctgtttacagcttttagaaaatttatgttccttcttttcaaacagaatgccttctttaatggaatctgtcttttctgcctcacaattttcttaaagaatcacatattcagttcatgaattcctagtaaaccaaactaccttcagagagcgtgtcgacaatcttgaaaataaagaacgttattaagtcttctaagtcattctgcacttacatcatgtaaaaggattatatcgtaattttcagactcatattctttcttattcccaagtcaccattaatgtacttcctcttcaggtctaagttctattttatttttatgtcattgtgcaatttactaaaaccttgctaacattttactgcttcaggtcaataagtcaccagtatgccttaagagcaatgaagaaataccaaggagatgga

SEQ ID NO: 827 - DNA, 350 bp, Homo sapiens
atccaacagctgatatagtgcttatgaacacacacaaatcaacaaaagaaaaaaatatttttaactatattaaggcgcatacatatacataagtgaacatgaaatatggtgaagatattaattaaagctgcttgggaatgatgcaggcaggcttcctgaaagaaatatgttccagaaaggtgaatgttataataaggggtaataaagagccaatctataggaactgacccagaaaaaaggcaaagaatgcataaaatagtatgaatgaagaagccgataaacgtgtggataaatctaaataagaattgacaattaaatattaataaaacaatcacatattaaaaggaaaa

SEQ ID NO: 828 - DNA, 30 bp, Homo sapiens
ctatacactactcataaaatatatatccag

SEQ ID NO: 829 - DNA, 67 bp, Homo sapiens
ctcaacagcctagtgttctaacgtagtttcggtctttgcagcgtgataaatgaaaattgtatttagt

SEQ ID NO: 830 - DNA, 58 bp, Homo sapiens
ttgtatttagtgtggatttactttgcatttcttgaatatgagctaagttgagagaatc

SEQ ID NO: 831 - DNA, 32 bp, Homo sapiens
ctgtaatactaatcaagccaatcttttgatta

SEQ ID NO: 832 - DNA, 309 bp, Homo sapiens
gagtgattgcctttattaaaatctttaggcctatactctaaataactaaaatctcaatgtattaatgtaataatctgtgtagtgtgcaaaacataaatactgcttattgtcccctatcatgtgatttgtattttcaaaattaactcctttaactcacttcagaagataaatttgaaaaaaaaaatctttaaaagcttgatgtaggtggactcaaaacttggaaaatgaattattatgatttttttctcataatttataaagtaataattacatacacaatatcaaaatacaatgtctacacttaaattt

SEQ ID NO: 833 - DNA, 75 bp, Homo sapiens
gttggttgaacgtaaatattttatagaaaaagtcactgaagaaaagtttcaatctatctcccaacacacatagag

SEQ ID NO: 834 - DNA, 333 bp, Homo sapiens
caacagagtaaagaattttccatctgagcagtctacagactagaatctataggaacatcttaggataattaagttagtaatattatcataatgaacatattttaataatagacatattctatattgactcttctatatattatgaattgaaattactggttgtatcctattagcttggtgtaacaacttaaatatcatccactattaagttagagcctgagaagctgtggatgaagtggtcttttaagcttctacatattttaagtacttctaggtgcactgataacactgaagaagcagagccttacatgagacaagacatcagaagtcatc

SEQ ID NO: 835 - DNA, 1850 bp, Homo sapiens
gtcatccaatatccacaaatatattcagacaaaatgtaaagcaaaagctatgaggaagaaaccaaagtggcaaaaattcaagaattgctgtttcataaaagtttctttatctttatgttaactctaccattgttatcatatgtgtcttgagaggaggagtcaaaagatctgtgaatgagtagttttcaaatgctgcagcttttcaaagaaaatacatctatttattaggttgttataaaagtaaatgtggtttttgccattaaaagtaattgtgaaaaccacaattacttttgcaccaatctaatatcttctttcaatcaattatgtagtttgtgaactgtagttgacttcaaatgccgccgcttttcttctcctccacttcttccatccacaaactccaattcccagtaattagtactttcaaccagatatcaaggagaagaaacagatgaaaactaatttaaggtaatcaaatataataacttttggcaagggtttcaagaaagttgaaagtggtggctaaaaagaggtttggattatctgtggaatccatttatcctgatgttttcaaaatatatgacccacagtactcagaaaaccaaaacgaaaaacttacctcatccacattttcaaaggcattgatgatgtcataaggtaaacaagacagcagatcgatcacaaaccaagttttcagatagttcatccttatgagcttagggtcagaaatgacctctccaccgggccccacgaaagtcgtgtgaaaatttaaaacgatgtcaaccagaaaaataacgtccaccacactatccagtaccagccaggctatgttgttctgctttgttttgaaggaaacattataaggaaccataatggcggtgtagaaggtaagaattaaaatcacccaatcccaagtagttttaaaagcacaataatgtaaaataatgtgtggtggcgtctttggcgcttcttgtttatactgaggaaggatatctgatcccagctgaagaacctaaaagagagaaaatgtatttatacatgactaggttatctctgcacagtcagtgatgaattcaaatctactggcagtcaaaccacagccagtcatgctccacagtcttgcctccctcttctcctgagttgtcctaaaatttgttcagaggaagtcactccaagtccaatcactctaccaaagctgatctttctgctgttctatctggcatgctctgatgcagtagccaacactgatccacaacactgctggatgtccacttctgcaagtgcctcctgcacactcactctgcaagcctgcctagaatcacatggctctcatggactgtccagcagttatttgggtgagacaccattatctattcttcatacacatttagcacctcaggaagcataactttgattctgatggcctcgctggaccccggcatcccactgttggtgatgctgttgttgagtgatactcagcaagggccctgatgggtggcacagcagtgtaaagggttgtaaagggtatcgcctgctttttcccttcctcccttagatctggacttaaagaatattgtgtttcttgcccaactgcaaatttcctttagggaaaaaaatattaaatactcaagtttgtttctgtataccaattcaaatggaaaaattttagtgtaagtttatatgaaccttgagttacactaattaagtctaattacagcagaaaacaaagatagaaagcagatgacagagcaagagtagaggtttgtgtatccctgggcaaaggtaaccaacacaggacatagcattgccttctggaacctggaacctgggaattataaaaaacagttgaggcg

SEQ ID NO: 836 - DNA, 795 bp, Homo sapiens
gacagttgaagggataaatcaaaaacttctgccctgtgccatcaatgaagccaaagacaatgtatgtgttaaagagtttggtaaatggaaatttttaaatattttcaacagatttgcccattgtatgtattcagttattcagtgtctctaggactaatgggacccagaaggtaggagtcaaaaaggccaaatcataaaatcataaatgcattaaatatttagatgtaagaatggataaaaataaaaatacttgttagcatgtaactctgagttataatatatgccacaaaacaaaacaaatatactagcatctttggcagcttgggagagtatcctaaagttcctctcatatacagaacttacatatctgaaaactaagaatataatatccatttttactatttttgatatggaaaacatcactggtggtccctttaattgtatgttagaattgttatttttattttggtgtttgtaagaatacttataaagatattttatgtatttgccattatcagtacctcagttatgtttttcccatgatgtcttaaattacttaacagcaaatcatcctaccaggaggtaagattcatgttggggtgaagtattatacaattgtacataatcatgtcttttcttttgcttttcaactactggcctgtcaattccaatttcattgtgttaaacatgaaaattgccttcatattcaatgttagtagtttaccatctatatatacacagtctatgtttaaccacaaataaatcaaacttgggaaataagaacaaactcagtac

SEQ ID NO: 837 - DNA, 124 bp, Homo sapiens
ggacactgtgcctactgtgctgacagatgtaagccctgctcagtagcctggattaatgcaggtctcctctaaagatggaatggcatcaccctgagttcagaaagtcttaaacctggctatatat

SEQ ID NO: 838 - DNA, 102 bp, Homo sapiens
aagatatctgtcttacatttctttagacattcaggacccaattctctagacagtgatttgcatatgtaaagccctccaaaaaaatgcaagatggggacaaaa

SEQ ID NO: 839 - DNA, 1663 bp, Homo sapiens
aaatggcaacaacaaaaaacagtgcacaaaaaataagcttcatctttttcatatgcaaagcactactaatcttcactctgttcctgggctctttcataaaacagtaacagactcttcattttcattgttatgtcatttgtgcttctataagcaataagcctttggtggaaggaggatgaaatcacattttttgatgtatttttgtaccaatacagacacattcttcctctctgaagatctgagagcattgactctaacaaagtcaggcccactgactgatgtggcagggcgtatatatttatctctacccaacataaaagtgaacaagctaaaggcaatcagcagggtgtcaatgcacgcagaaaattaattaactacctttatggagactggaatctttgaaactggggatcagctccaaatttgggggatcaggtagaattgagatcaaatttatctgtctttgaaaaagtaaaagcacctcaaattccatagctaaaccaaatacttgcattgagcaaattacaagagttttgagtaccactggaaaaacaacattgttatacttatttggtatttcttttatgtctatctttggagatctaagagcatgcgctgcaggtattcagactaaatgtctatcgacaatcttgttatttctgtatgctctctgaaatcgaccctaagatctgacagaaagcagttttatatcagaaccaggtttatgaataagggatgactggtaaagaaactaacactaatcacagagcaaagaaaaaaaaaacagatgggatgaaataggaatacgtttctcaaaaataaaaatgagaaaatgtcaaggggaaagtttctttcttttccgttgatacagtgaaaaaacaattctgagtgattctgggtgctaagggagaagattgtcttctctatggccccctttcacttgttgtcgctctgttgtgtaacagacaaaagaaaaatcctgaatcaggtgtggttaagaccccaaaggaatcatgactataaaaattcacaatcacagaaacaacctcctacatttcagcttgatttgcagaaagaaacaggcaactttaggcagaagaggaactagctccaaaatctaagcatttttgcaaaagaaagttgtatctcattgtctgctttaaatcttgtactaattgcatattatcttttaaatattgtgattattattactagttaatatttagttatattaatgtcttattttggtcttcagaaacatgtctgcacatcaaaggattcatctttccccaagctaacagtgctatttagagcagaaaaccaaaagtctttttgttagccatggtctaagaaaaactccatagtcttctaaattcagggaacatactttacttcctaatcccctccaaaccagattcaatatttacgacaagttaagaaaattactctgaagtgcttcgactcacttttctgcagcagagaaaactgataagcgtatggattttatctttctcttttttggtaaaagttacctgagaatattttgtgagtgcaaacgtagtgctcagcatagttttggtagcttaatgagctttttggcatctttcataccagtaatacaaattatggttatagaagacatgtgaacaataaagctattagc

SEQ ID NO: 840 - DNA, 193 bp, Homo sapiens
aacatgaaattgcaaaagaaaccaattaggacccacctccctttgagaggtttttctgaggcacaaaggtcattttcctggcacatgagacaccaaccaccaccatttcactatatgccaccctaccttctccttccccatatgagttcaactacagtaaagtcatactcaacgtcaccatactacctcatct

SEQ ID NO: 841 - DNA, 314 bp, Homo sapiens
gggcccatttcttatttaactttacatcctttgcagagtgccaagcacagagcataccctgaatatgtgtttgctgcatatatgcatgaagcaatgaaagaactccctatctgatatgctcaaagaaaaccttacactctacagacatgacctgggatgtcatgagctacactcccatttcaaaagttggagagaatgaatagaaatatttgggatttctatatttctacaagggaaacataaattatcagctaagtatttataagatcatagccagaaatatctatattaaatcattttagggaagaaaaatg

SEQ ID NO: 842 - DNA, 511 bp, Homo sapiens
ggcctcctcttctacctgttctttcaatgctgatgtactacagtctactctttccatactttttgtctcatgtgttttctttcttcagcttccactaccaattttttgctaataaatacaaacctctaagcactcctctcctgagcctcagatttgaactagcaaagattcaatggttatctccaactaaacatcccacaaacacccccaaattcacctagctaaaaattacacccagcacctattgccttcccacaccccatctgtacttgttcttccctgggtgttcccaacatcagtaaaatgtctccccatcaacttcgcgcccagagcagaaacctgcccagtcattgtccagtcctctctcttcctcactgacacatcagaaagttgtcaatattgtcacttctaacatccaaatttctctcacaccaactcctttccactctaccccctgcacactactctcatcatttcttgtatagttttttcttcttcttaaaaaatatta

SEQ ID NO: 843 - DNA, 270 bp, Homo sapiens
tagttaactgccatgaactttacaatcatccaatttctctaaacccgatgttttgttcctatctctgttcatcttccttggatccccttccttattttgtttgccagacaaagtccttctccctgttcaaaagtcatttctactgggcccttaaaacttgaaaaacaaattcttaagcctgtgttctccattcaataaaaagagaccttgaaaatttatagaaaaaaaatttttcagattgcagatctaacatgataaaggaattcttca

SEQ ID NO: 844 - DNA, 1411 bp, Homo sapiens
gatagtctagacccatatatgaagaaatagctgtcaggtgaacaggaccatagagaagatatgtataaagtaacatggggccacagaggaatgagtgaacaattgtttttaggagttggggaaaagcttaaaatatttggtcacaaagaatgagtaaattatagggaaatatggtgctaactaagcttcctccagctttgatagggtatgaaaaagtggttggcaactgatctgggaaattagtgaagcccttacaagctcggatttggtgtcactgaatgctttcttcaagagatatatattgtttggttgtttttcaatcctcagtattaccaaagaggcacaatttggagggaatgtagaggaatgaatgaaggtgagggaatgatgctctgcatcataatgtgaaatatttcatttggagggaagtagcctcagaatttgtaatgcaattgggaatatttttccattttgtaggtttatactttactatctctgagaatttatactgtcctcagagtgtatgtgtggtagtgtggggtgtgtgtgtgtgtgtgtgtgtgtgtgcgcacgcacatgtatgtttgagagagagagggcaacagcaacaaagaaagagagaaaaaaacagttaatcactaacaaagaatacaaagggcatatttgccgctcatttaatagagagatttgaaggggaagaagtctgagagctcaagcccacctagattgtctcccagagctggattcctttccaaggccatctaagactgccccacccagatgtcctaaggcacatttccaaactatcactcaaacttaaagaaatttactattgggtaaaagagatggatgttgaggccagacttgcccctgtggagagaatttccaaaagatgggcagagattcacccaaaggaaattagaagagaaggtaagcctcagaatacaggaataaggttgggaaatgttacagggaatgatgatggcccacaaagtggctatctgacaatgatttaacctcttgggtacatttctgttgagccatgggaaagataatgctttgaagaaagtgttaaatgtcttcctctagtacaacttagcacagcaaactcttgaaaggaagtgaagaagaacatgaagaaaaacagtgatccctgctatattgtttgttatctctactacctcctccaccaaacactccacagtggcccttgagacatggacaatgttgtcttgaaggagctgtgggtcatttgttactgggtttaactcttagcaaataaattcatgtccattggcagagtgaagagtagtgagtagcaagacaagactcagaaaaggaatggtcaaattaatagaaggggaggagaccccaggctgttcctttctctaacacacacatgcacacacac

SEQ ID NO: 845 - DNA, 132 bp, Homo sapiens
tcatactccaactacctaaatacactaagggatgaaaaatgctaatattttcataacaaggagaaatacattccaatgaggttatatgcaatgtattatctaatatttgagaattctccgtaaatccatata

SEQ ID NO: 846 - DNA, 592 bp, Homo sapiens
ttattcatctgaaaacaccaccagcttagtagccaacaatgtcacaagctgacaagaaaaagtgattctgcaaaactcttttactgagctggtagaccatgtccaattttctggactcagtgctctaaagaattctgctgcctctcttattttcaaagtagctagctataaatgtcagtaaatgccagcctcccagtaagtaatgggaaaaaggagaagttaggagatactgagtgcgtgggtactactgattgtccaaaaagcctgtagcgcatggcatgggagatcaaatacaacctaccaaccatatattgtttaaagtattaagtaagcataatttgatttaggaaaaccacacacaacataaggaatattatcaaagcgagtccgtgaacatggtgcaaggcaggtccaacttgagcctaagaagcagatagcagctagaggcagggtctagaggtgccatgctggccttgcatcccaggcaaagcaaatcctttgctgttgctttccaatatgacccaactctagcccacaagtcaagaacagtacttcttcccctttgggtttcagccatggcatgctggtaaat

SEQ ID NO: 847 - DNA, 249 bp, Homo sapiens
ttgcagccataacctaaatatgtaaaatattatcctgaacaaaagtaacatgtaatctacttgtatcctttaatataccagtatgggtgagcttcagagactaaacttagagaacagagcactgcaggcaagagacacaatgcctaaaaaaattatggctaatactaataacaacccccaaaatacaggaatagacacaaagcattaagcatgtcagaaaggggcttgcattaagaagttcatggatga

SEQ ID NO: 848 - DNA, 57 bp, Homo sapiens
ggaagtccatggatgagacttgcagttttctatctaatacctattctccttataggt

SEQ ID NO: 849 - DNA, 545 bp, Homo sapiens
taaaaagcataattaataaggaatcaacacgaaatgactgggaaagattgtcaaatgagaatataataaagctcaaccatcagtatcaccattccagtttaaagtgcatctgataaagaatccttcattaactctcattcaacctcctaccatttacaaggaccagaaagagaaaacgtgggttgttattatattataaaaatgtgcaaggaatttcaactgtaaagctattaaagtaggaatgaaaaataactggcggcccatatatgctttgataccagaagcataggtaacaagatgactaaaagaaggcagagaaataatatatccttctgcctcttttttagccagtgctcctttgtttccaattcaacaatgtagctggatgatagaaatctaattaaaatgagcataaaagttcaggcagagcttaacctaggagtttaaacagtattattaagatagctcctcttcatattttgactgtcttttcttgggttggttgaactgaatggatctcaggctccatgccgtagccctttatg

SEQ ID NO: 850 - DNA, 151 bp, Homo sapiens
tgtggaacagcatcactcactgccagatttctaccatcagggagagtaagatgtaaaaaactacgccttggccaccttcttataggtctgattttctaagaaggcatcactttgggaaaatgtgctctaataaaattgttgcttccctgtt

SEQ ID NO: 851 - DNA, 78 bp, Homo sapiens
gtcctggatgaagaagatgctgtggattataatttttcatgcaccacaatgaattacagagtcagaggcagtagaagt

SEQ ID NO: 852 - DNA, 327 bp, Homo sapiens
tacttcatgccaaaaacaagaggatggtgacatatttgtcaggtatacagaaacaaaaattaagccagggacacataccaattacaggcaaagacttaagcagcaaaaagacagaaatctgtgttgacaaaacaaagcaccataaatttgtataagccaactatataaagcaaaaactatgatgaacaagaagaagaactagttagattattttagattgacaaaaacaaaaataaaattactacacatcaaaactgatcagtaatataacattcatataatagagtattattttagtcaattactccattaaggacagattttttt

SEQ ID NO: 853 - DNA, 1289 bp, Homo sapiens
tctaaggacagattttaaactttcccaggaaagattttaaaatcaattctctctccctctttttattatcccaatcaggtctttgtcctattgtattctttattttttccttcactgatctctaggctacattctacttgacatctatacaattatttacttagtatattttattgatctattgttttgactcaaatacatttattttaaagaagaactggtggataggaaaatataaaccaagagcaaaagatagaaaggcccatgccccgggtccacaaccaccagctttgctgggatcctgtcccagggtctttggatagccccgcctgaagtgcccatgacgggctacatgtttggtaaagggatctatttcgctgacatggcctccaagagtgccaactactgccatacatctcagggaggcccaacaggcttaatcctgttgggagaagttgcccttggaaaatgtatgaactgaagcacgcttcacatatcagcaagttacccaagggcaagcacagtgtcaaaggtttgggcaaaactacccctgacccttcagctagtattactctggatggtgcagaggttcctcttgggactgggatttcatctggtgtgaatgacacttgtctactatataatgagtacattgtctatgatattgctcaggtaaatctgaagtatctgctgaaactgaaattcaattttaagacttccttgtggtaattgggagaggtggccaagtcactcccgatggctctggtataaattcagccgaagcccttctgcaccaactcacctggccggctaagttgctgatgggtagtacctgtactaaacctcctaagaaaggattttacagaaacacattaaaaggttttctccaacttttcgagtcccttgttttgtgttgtgtttgtggggaggggttgttttggggttgtttttgttttttcttgccaggtagataaaactgacatagagaaaaggctggagagagattccatccgcatagactagtcctgtggaaaaaaaaaaaaaaaacaagctccattagaatgtctgccttactggtttccccagggaaagaaaaatatgtttccacccttttttctaagtgttcatctttagttttgattttggaaagttgttaagcattcatttttagttaaaaataaaaactaatttcataccattaaaaaaaaaaaaagaaagaaaagaaaggcctgtgcccctggagtgagagggcagggatgagaaacagcaaaggaggcaggtgtgaggca

SEQ ID NO: 854 - DNA, 609 bp, Homo sapiens
gaaagaataggtcttttggagaatagacaagaatagaattggcattgcctgctgcccactgggtgaggtctctatctctttaatcagccccttataatcaccacactcgaggaaactctttcctgcatgttttttgaattatcacccctctactcacaccacccacctctctcctgacataactcaaccagacctacatttttctatcttctgttgaatttctagtcacttaatacacaaaacattcatttctttctaacaaaaccaaagcaatgtcaccacccatgggtgcaagaatggtataaaccccttcacatccagcccatcaatagccccaatttgtataaatgaagccagtaagtccctcccagactctaagaccaatctttgtcgtacacaaggaatatcggtctagcctcaaccattacttctggtgccaccctgatagaaaacttcattttgtcagcaatcaacgtcctgccttgagacccaggttccctatgactgaacccctaccctgtatcctttttattctttaataagttcctaattgatgttccagcaccttatcactagattcttgtttgtccctttaagagaaggagttac

SEQ ID NO: 855 - DNA, 634 bp, Homo sapiens
aaattacaattttttaaatctctgcctgctatctcaatctagacaagaaattgtattctagcccttggacttcattctccttagaactggctcactgatgtagttgccaaagctttatactattaaacacccgtccccttgaaattccaccaattgttggtcctgtccccacttggatattgtggcacctccacgtagaaggtatacaacaaatggttgttgttttttgaatagacagtaattgatactgggtcttgaatatttgttaatgtcacttcttcctcaccagaccaagaaccaataacccaaaggacatcttccttcagactcacatcattgactatctttctctggaaagtcttactttgctcccatgtacaaatccctgacctttgttggaatgacaagtctctccagactcaaattcaggactgggattcatatcaagtcttgtcagtcctggttaggtactggtccctcatgttcattatggttccattttatgaagcaatagaaattgctaagttctaaaacaaagaaatgatcacacatcctccaagtaaccttaataattcctcttcaagtacatcatgttctaagatcacagaatcactccaataaagtacaagaagag

SEQ ID NO: 856 - DNA, 166 bp, Homo sapiens
tgaaagccactttgaatgaatgtcgaaatgcgtaaagaatccaattattttagtatttttgtaccatagatttttggtacttagaacacttagacttttgtatagatctaaactcactgccttggttttcacctttacatcaaatcctcaaaacaaatcaactgtc

SEQ ID NO: 857 - DNA, 210 bp, Homo sapiens
agaacatataaggagtgcaatcaggaaagattatcgggggataaaagacaagtatgcagaacacagctcatttttgtaaaaacaaaataaaatcctaattatttcagttgcatacacatagcaaaagagcctggaacctcaccaatctgatgccagtgggtaccagagagcaaggaaataaaattggaataagaagacatttattcagtg

SEQ ID NO: 858 - DNA, 362 bp, Homo sapiens
aacacatcttatttttgtaattttcacagattttaaaatagcaaacatctcaatttttaaccactttgcctttatatacaatgccaagaccacttggtacttgtcagcaaaatccagtgatgttagaatgagtattgcacgtagctccacctctccctctggggaaatctcacctgagctgtgctcctggattagcagatgtggtctggctcacccgctatgagaatgggtggctggagaggagctggcagacatcctgcaagagaacgaggctccttgataagtgcttttttgaccttactgtaactagtcataaagatctttgaaaattaaggatacatgccctcgtttcccttggtcat

SEQ ID NO: 859 - DNA, 147 bp, Homo sapiens
gtcatggaacatcataagtaggaattcctcccacgagtcctttctttataccctgcggggctgtgggagtccccactaccgaagagcagcctgagtactgagtgtgggttgtgaacactatggggtgataaagagtccctttcttat

SEQ ID NO: 860 - DNA, 2104 bp, Homo sapiens
atgtatcatcacagaaagttagctacactttcctttgcctggacacagcttcttcccctctgtatagctatgacttccaaccaaatactcttgtcgttcccaccaaaataaggaaagggtaggttcctttgaaaagaaacagaatgattctgttgggaaaggatcataacctatcacacaactcctcatctaacatgaaaatacagaaatatgttacatactgttacatctttaaaataaagctgcccacttcattttagttgtattacagaattctaattctgacactgcaatttatgtcttttgatgtctatcaagaagatatattaaaactctggttaatgaaaagcaaatgttttatatttatatgacctctttaatcttttgcatgaaaaaggagggaacattaatctctgacaaaagaagaagcctccgtgtggagagaataaggaataggtcccaatgttaacagaaatgttaattaaaagagctagtgatcatattcaatttctaggaccaatttctagatattcctagcatttatttttgtctcaatttgaagtcccatcaaaagaagaaaaacactcatttatggtcttcattttcagaacaaactgagtctcattataaaatgttcacatttttgtactgcaattcatccactcacaagaaggccaaaggcaaaagattaatggatcacaaacgacggctgctctgcatggcagaatgatcatccccctccaccctggcataacacaacatgacctagcacccagctcttctacaacaaattgcaacacccatactggaccactaatactgttttcaaaaagcttaatgttgtgaattcttgcatcctaaaattcaacatgcatactgtttcaatttataaattgtattcaatttataaatgtatacatactgtttcaattacaaacccctgaagataagggtcatgagaaaatgttggcaaaatctgctctgtagcactgaatagcaattagtatcaacaatgcttatggtgtttttgaagcagcttttgtgtttcaaattgtttactgaaggagttaattttatgttgaacaccaataacattcggggaaaaaataacctcgaaaactatttatatagcaaccattaataaaaatagcagtatcatcaggtgatgttttataaagctataattagctggtgagcacatttatggaacagctgtgatgtagcagaccctgttaaaatctgagataggtacaaaatatatagatgacagacgttttcttgaagaaatgttccatctacatggagcccagcgcatgacagataacactgtaatttggtaagaaaaggtaagaaatagtctgaaatcaaattgagaatgcaaatagaatgtaaatgctgagattctatccaaagaggtgtgaaccaacccagaaagcgttaagcacatatggctacatacttagagtagcgtggttaggagggagatgagactgacaaaaccattgtacggcgtagggaaaatagcaaggatctcaagcctgaagaaatcttaaacgacaacaggaatttcagatagagataggaataagcaactttttggtaaaatccttctgactaattcttctttaatcattgcctgtggcaatgaacgagaaagatgttgtcagtttaaagtacccagactggacacttagagcaaagataagggtaatgacattaagcgttcatgttttcaggagattccagaaaaacctaaattgcttgtgatatcttgggctcatattcatactttgggttccacttcagaaattctaaccgttatggaagagtaatatcaattctacagatcttctgtgatgaatcccagagcagccacttctcacctagttggttttgccaaatacttgtaaatagttatacctgaacctgagtcatacaggaaaggaaaaggctgaaagttacttacataaataaatccttgatctcagcttcttttattttaccttgttgatttcacttaaaggtgcatttaaaggcttttggcagcagccataagggagaagctggtattaaatgaatcattccacttaaaaataaattataa

SEQ ID NO: 861 - DNA, 84 bp, Homo sapiens
atttgtaagctttggaggggaatgaatgaaggcaggatgttaagagctttgatgtacaaaggaagaaaggtagagctgtgtgag

SEQ ID NO: 862 - DNA, 287 bp, Homo sapiens
gaaaaaaaagaaattaaaaactgcattcagctgtaatacttctagtagaaatattgacactgttaccttgaaaatagagcaaataagaaatgtcagtaggaagtaatattctcagcatgagaaaaacagatacaaatataaaatcaaaattagttgtcttttaaattttaaaaccctgtcatctttaatgtaaatgagatatcagcatgaaatcattatttattttgttctttctaaaatacagatattccctagttccattcactaaaaaggtctaaaacatcaaa

SEQ ID NO: 863 - DNA, 116 bp, Homo sapiens
tttcaaggccaatccaagtctagatataaagaaaaccaagtagctacgagtacccctggtgactaaattggggataacagagcagtgggaaggacaagggagaatgaaaatattca

SEQ ID NO: 864 - DNA, 351 bp, Homo sapiens
tttcttaaaaatgaaataaagtaaaagcgctttaaaatataaagagataaatagacaattcagttaaccagttcctgatgatcaaatttttatgtcaccactattaatattgaattctctttaaaaagggccatattgattattttattattacattttattaaactacttaaaagttttaaaagttaatactgtcctaaccacagaatgttaaagattaaattatgagtcaaagactcaagttaattgttagaatagaaacttattagaaagcttacagaatctgcaaatcttttatttcctggaaagtgaaacagctgttgaaatgaatcttatattaggtaggaaata

SEQ ID NO: 865 - DNA, 171 bp, Homo sapiens
gaagagacttcagaatgtcacaccattgtctggattttaacaatggatctcaaaatattgagattgccaaggttttttaaaagtttttaaaccaagataaactgagaacgttgaagtaatgtcataacttctctttattaaaaatcaattctatcctcaactgaataaagt

SEQ ID NO: 866 - DNA, 68 bp, Homo sapiens
aaaaaaaaaataaaaaaaattcatttacaatagcttcaagaaggataaattacatttaacaaaagaag

SEQ ID NO: 867 - DNA, 227 bp, Homo sapiens
ccaaatcctgtgttttgaatcattgtctaaaactgcctctcaataaacactttaaaattgttcccattagccataagatcttaaaataggctctctctgtttatataacatatcagtgaaaactgttttcactgcaattgaacatccacttgtgaagaaaatgaaaagtcaaacatgtcaagctcttgtcttcagattttttgattggcttattgggtattattcaa

SEQ ID NO: 868 - DNA, 183 bp, Homo sapiens
caatttccaagtacttgctaaagttgtttggtggggctccaacatcataacagctaaaatttgtattaagctatatcgattgaaagacagttcaattacttctccattaatatgagataataaaactctccttgtggaaaacaaggaaatgtctcatttacagtttcatttagagatatgtct

SEQ ID NO: 869 - DNA, 388 bp, Homo sapiens
tgaggaattgaaatgaatagaaagccctaagcattaggcaagaaaatgtgcattatagcttgttatgatatgtgagaagagggggacaaggacataagcaaaggatgtggaaggacatatatgcttccatgtgcatcagtgtgtaagagatgggctgtacaagcagtgtggtaggcaaggattggtttagggtggctctgcctacatatctcagaagaagactaatcagaatcaggaagaataggtaatttgtatgaaaatctcagactgagtcattgtttgtgttcagtggcatccctaaggtcagtgaatccaatgctctgatcccattaaattcctttttctaagaaatcctgttatcatctctctcacccttctcccttttgaa

SEQ ID NO: 870 - DNA, 27 bp, Homo sapiens
tttcacaatttcatttcctggtcattc

SEQ ID NO: 871 - DNA, 190 bp, Homo sapiens
aatgctggtggttttaatcactctatggtattattttaaaaaagagaatctctatgatacctaattcaacattttccctaaagatggttctggcaaatgttaaggagcaagaattaaagtattacattgaaatatctatgccaaataataaaagaaatgaaggaagatacaacttatctttaaattccta

SEQ ID NO: 872 - DNA, 179 bp, Homo sapiens
tctactcttagctcagtgcacactgtataagggcactgaatgaatagaaatttgtgatgttgacatatagaaaagttctaagaacttgccttctactaactgacagaggtagtgacaaatagatgaggaccttggagtatggtgagatggcagtggaaatgacagaaaaaagaagagaa

SEQ ID NO: 873 - DNA, 841 bp, Homo sapiens
gagaaggaagagaaagaaaatggtaaaatgcaaatgtaaatttctaatttggcatgttatataccctcaagtgtaaaaattaatttgttttaagctattaaaaaaggaatgacagtttcaaaataatgataatttaaaaatagaggatacatgaaggacagctctttatattgttaccaatgcataggtctagaatgtggctcttgagtgaaagaagtgatttttgtaattgtttcaggtattaggcagacaaattcatatgatttatctgaaaataagaacaatatataaatcagattcaagcatgtgtcaatatattatacccacttgagcactgaataaaaatgagttgtcctactggctagatcacagacattacatatgggaagtataattgtaaattatctaatgctttgaattatatagcgtttgaaggcatttaagaaatcaaacaattattttttttacttacctgaaaagatttatagaagaaaataatacaattccctatctgtttattatacatgcccaaaaatcctcctcaatatttttccccgcaatgaaaggaacaaagtggtctagaaataacaagaaatgataacagcccttagaatctacaagcctcaaggggtgactgtcaccagtctgctgctgacagacacaaagtgatgtctgtgaatgcatggctcaattgatggtccatgctccaaggactgatctgggtctagttttgctatttttaattatgatcccaggcttgcaacatgacatcatattttcggggtctcaatatgcactaactcttaagcatgcaggagacctgaaactcctgaggctaatg

SEQ ID NO: 874 - DNA, 211 bp, Homo sapiens
caagtaaacatatcctcccacagaagaaagaactgaacgtggactaaagtttacctcctggactttcattcccaaagaagtgaggtttttgcgggacactttgtatatctgtttactactacagaagattttaacttcacaaggaaactcataataaaaggaatgtagcatcttgtgtataaacgtgtgtttcttaaaaatggctcataat

SEQ ID NO: 875 - DNA, 62 bp, Homo sapiens
tgttagaaattgtcaatgttacgttgttgattaggttttattgccttcctttaagaaatgtt

SEQ ID NO: 876 - DNA, 41 bp, Homo sapiens
tactgggaacttcaattttacaatactagtcagcccaaaac

SEQ ID NO: 877 - DNA, 46 bp, Homo sapiens
gtaatctccgtgattatactctaattatgtaatcatgtacaaataa

SEQ ID NO: 878 - DNA, 105 bp, Homo sapiens
aaatgaatgggatttctttaacccgcaaattattattattgaacatttaggttatttccagtgtaaaggtaaatctacagtcacgtatcttgtaatttaggcata

SEQ ID NO: 879 - DNA, 1607 bp, Homo sapiens
tcagagtctatttttatagttgtgcattatgatttgctcattatacaaaagcaaatgtcatccatgtcttctaatcataacacagtctacataatttttaaatttacagaattaaagcaggactttgtatctactttctgctacataagaacatttttattaaaaaacatttcattaagcacaccaagcaatgtgtttaatacatatatgcttcaaaaaatatacttttaattttttgtattagaaatgtattattacattcagtgaagttttggatggtgactatatgtgggagacactaaactaaacatttcatttcaattcctacttatgcgttcatagtcaagggcattgcaacagtttctttattagcaaccattacataggtaattatattttctatggaatagacagtggcactagaaaagacagttcattagtggtgcagttatatattagagctataaatcctattctttttaaaaacacatacacgtgcacactcatgtgctcaattccatataccactgtgaattctcaaacttaaaggaaaaagatttcaaaagtattagtttttcaaagaagaaaagccaacattaagttttaaaacttctttcacaaggcaaaagagtaaaaaccaggaattgattttcaaatgctggtggaatgagaaattctttgatgtcattgagcacactggatattgtggcactcagcagccaggagagtcctcgccaaaaaaacaattattgagcatcagctgttttctggaactggaaactacatatagtcatacatgtttagaacgatattaaaataagaatagatgttcttggggacaagagaaagaaataagaaaaagtagactgtaggtgagcagagaagagaggactgtgaataattttatcatgattagtggcaaattaatcaccatgctcaatatttactgttttctctttggttgaataatgagcaatcactgtaaatttagtatagtatttattcatttgaaaagatctcagaaacatagacttatttttagaagatgaaaataaataagtcctggatgtttgttgccaaacagaatttggaactaacaaaggtcccgcatagagtgccagccagccgctgataaatggatcagtccttctctacattgacacagagggagaaaagaatgctacaaaactacagccattttataagagccagatttacctaaatcggtcacttttcaatctgttgtgtcaacattccatggaaacatctttaagccttcaataaaatgcttatgcattaagcgccatttaggccacataacagaccacatttttctactcatatttggcattacaggtagtcaatgataccctgacacagtgcttagcccccaagagcttagattctaaaataagcaatattgaagtacataaacagaaactatatgcacatcacttgtttaaagattttcatggaaaacctcaccatttataaaccctcattataagaatgtctcacttctttttttttttagtaagaaacttttatcctattcaagccattatattttttctgtttttgtttaaaattctttttcctgatacata

SEQ ID NO: 880 - DNA, 106 bp, Homo sapiens
tgtctcatttctagtagaaatccctcatgctatgagaaagggaaaacaattcattatcactatgcacattactagtcatgggtaccatttaacaagcattttgtac

SEQ ID NO: 881 - DNA, 119 bp, Homo sapiens
gaaaagattaatagactgtctcctaaaataactttgatggtccactatatgtctatcactcttagaaaacttattttaaacatttaacaatatttgtggggccttcaagaaaaaactga

SEQ ID NO: 882 - DNA, 1476 bp, Homo sapiens
aaactgaaaacccttcaatattgctcttctcctgatcatctgagaagaccacagatctttttcaggaaactaagaattctctctactgaaagaactagtattgagctgcatgctgtaatttctatgctccaagacatgcacaaccatgggactttagccaagtctcacaagcaatgtgctatacactcagtaaccagacttatgcttattgtatgacactcataactggacagtcttcacaacgctgaggtttgcatagcagactgtggagtaggaccacatgcttttgtggttctaatccatgctatatgtgccctggagaaatagggccaccatgctgatccatacaataatcgctttacaacagggtatggaacattcgttttactgtctttcttttttaatgtagtttactaaatttgctttaccattagattacatgctgaacatgcttcttgggtagattttaattgaggaacataactcttcagaattggacacagatgcaaattcccaagccatcagagctcttattaacatgggattttaagctcatattggtcatctgacttagcattcagaaaactaagctaaaaaagtttttaagtactttctatacaacaagagcctttagctttatattacttcctttctactttatggcctaagaaatgtttctaatatctctgaaagttttatcaatagcttgcaatgatacgcttctacagttagattttaaatctctaaacatcagattcacctaaaattacattgaggaatcacagtgggaactgtttaatgagttaattagtacttactcttctaatagagttgcactcatcaatctgggagataaatagcagatgcctgctttctgagttatctttcttttcccacatccttactgtccatttaactatttgatccaatcgggacaactttttgagtaagaattggatatattcccaagttcaggagaattcaattacctaggatgtatctaaaaaatttagcagtcctgtttggaaagctagtaaatgaattagtcccttacccttaggaaatgcaatgattttacttgaaataaaaaaagagtcttttctctgtggagggtgattatgattaactagggacgacttctaggctcaggacaagggtaactctgctgctgctcatggaattcaaattaagaagatcaaaattccaggacactttaaaatcaggatgctggcaatctagtgttcattaatactagacttataaatggcatatacagaaagaaaaattgaaattcatatcacctaaatgaaatatatatttgcagatacagaaaatttatgttagaatacacaagaatctatcaatagtactaattacctctgtggagtagaatgatgggataatgagggtggagggagacttttacttttcacgttacacactgttgtccttttttccaccacagatatgtagtac

SEQ ID NO: 883 - DNA, 360 bp, Homo sapiens
gaagtggctcacaatagatacaaagaggaaagttggaggagtgtgagttaagaatctttaagccacagaggcaaaggtcctttgccccaatttacatatttgatctcaatttgctccagtctatatcccaacatctaggtatataatcatagccagttgtttctcttattcagacacagagatataacaagtttataaacttctgggattaaatagtcccagaagtatttaatctgttagccacagcccttcttgcctcttagagaaccaccagtactgcagaaatgggaagttttcttcaagctctgtgttagaatttaaaatatttttcttagtgaaattataataaaacttgaaaat

SEQ ID NO: 884 - DNA, 119 bp, Homo sapiens
cagtatggatatagcccatatttgaaattggatttctctgagtctgtgaattgcattccaaacaattgacttagaaatgaaaattactacaacaattaatttttaaaaatggaaataat

SEQ ID NO: 885 - DNA, 932 bp, Homo sapiens
ctagtctttccatgtatacagctttgagatatgtgtatgtaggtgatatttttaaatgtgccagctgttaaaaaaagaaggcaaatgcaaaccacaaaggagtaaaaggttagatgataaaatcagaatgtggaaaatattaaagatgaaaacatttcagtttgaattagtgcatattcaaagttgagaaaattttcatttgaattctgtaacatataattatgtcacttccaacatgaaagtgaattagacacaaactaaatgctttaaatacaacatagcaaacaaaagcacataatcaatttatgaactagttgtataactttataggatgccagtgtacaaaaaacaacaacgatctcaaatcccagtactctataaaagaagtatttcactttaattaatgaaagtaaagacaaattcttgaagagtaagttggataatgatagtaattatgatatttctatgcttgatcttaatgctcaaaaaagattcttgaaatcccaccaatttttttaaaaaacataattaagaaacccacaactgaaaaccaaaacctactaatgttactagacaagctttttacctttctgtaccttaattattcctcttggggtgatgtgacatctaaagttcttcttagctctaagacaattatgttagctaaaattattatgatatcacttatcctgagaacatagtaagcatataataactaagatgatcagttttcactattgaccaggctcataaataatcatcgaagaataatagttgaaaatattcttacaggaaaacatgttctttatttacatgattggacaaggtatttgctaatggagaattctcctacataccatacttgatgacaaaacttttaaatatttaaaggacaaacacatattgaacaaacagtgaaaataacatcatag

SEQ ID NO: 886 - DNA, 424 bp, Homo sapiens
cagttaattaaatgagttctttaaacaattatgagtgtaagaagaaaaatgtgatgaaaggatggtgatttcactacctaaacatccttttgtgtttcagagtcattatttatcataatgtagtagaagggagaagcacaattaaaatataacattaatgagagatagtttaatatacagtgttaattgttttacaaataaatacagtgttgaaattcaaaaacaaaggttagaagaaagacctgggtctgtgaggaaaatatttatagccccaaatcccatagcacttccctaatgtaataatttctgctttacattctgtgttgccaacacctgtctgtttgcaaataaacctctcacaatcattagtcatgtttgttcatgctgaacacttctctccttgaaaacacagcacctgcagagg

SEQ ID NO: 887 - DNA, 1503 bp, Homo sapiens
agaatatcactctctgagcatcttcaggctgcaactttggaacagatgtgcccaaacatctctaattgcacagctggcttcctctggaacccatcaacccaaaagataacagataagcacgaagcaattcggccaaaaactgcaatactgtgtagcacgtgaaaatttgtgctttgatttttatattggactagtggtctgcacataaaactagcaataaacagaatcctgcagggttcatgttttcaagagcacacccagccacatgttctctttaatggctgtactgaactaacactctggcatgacagggtttcttatggcttgaaccaggagtggggtgtgcatgtgtctggaagcccacaatgattgtgataccagttgaaaaggtaaagtgaatatttctcatatgctatgtgaaattcttcatgttgtcaagcttgttttgaagcttgaaagaaattggtcatgagctctttgtctgaaaactgacttcatcaatcatacttttcagggagaatatggttcctgtcaacacgggcattattctaacatacacacatagctggatgtgcctttcctttcaaagacttggctatggtacagtatagtttgaggtttataaagcactttgaaaatatacaaattactgtatcttgatttaaaaaagggaggaactaataccagaatagttaagactttattagatgatatcatttaataatagaatatttagatatgaatagaaccggtagtgaacgtgatgacaagggaagtcatacttcccaggagtgttaaaatatttctatacatcaaaaaatgccaaacaaaatgccatatttggttgacttaatcctctatctttgacaatggcataaagagcatgtaaagggaaaatacataattagccccttgctcctaattttgcttaaactcttattatgctacttactgaaatgagatgtttattttattattatcactgcagaaatccgagaaaatacaggtctattcaatttcacctgctagcctagacttcaagtagacttcagagcaataccagtttgtatggtctttttggcaatagcaggaaatgatacaagcgaaatcagttcttgattaagggaggagcagaattgcattagttagatattctggtagtgctgcaaactataatgataaatgaagacagcccaagacttaagatgtaaagttatgtagctcatgcaattcaatgtcagtatttgaaggctatatgatgaatatttccagaagtataagaaaaaagtaagaacaaatttgcctcttactgatgcttcaaaaatcatttgtgtatatttaacaaaagaagtgtctaaatagatctgaagttaaaccacagtactgaacacactagatgaggtaacattgagtattatacaagatttaagacttaaagggagggactcacttcatcaaaatggaaaaagccttgaagctggggtcagaatatagcgttccagc

SEQ ID NO: 888 - DNA, 669 bp, Homo sapiens
aaaaaaaaaggtgttctagtgttagcattgctattgagtagtctcacatgaaacttttggggcctcatcactttttttctcaactgtgttgaactatgtagcctcatcacctgctagggtccagttcttactccttaaaacaagaaggataaatgaaattagttttagtttcagctgtctccctttataaatctttttactaattctaacacatgtgtttctaagagcattcgaaactttcctaagagggatttaaaaatgttggcatgctaattcccaatcaagactgaggctctgcaggtaacttttacagcctactaataaaacctattttattagatttgttgtgctttgtcttaccaagaatataaacttcctgctttgaagaaagggaatgaagtttaattttatcttttaattccattcaaactgaaactatacagactgaaagtcctgcacatactataagatgtgctaatgaagttgcagattgttgtaaaaggttactatgaaaggagaatttaaacagaaattatgagagtgtatattctcttttgtactgtaattcaatagatgaaatttaactttgttttatcacccttggcaggaaaatcattcaacctctgagtctcagatagatgatttgtgagaaatttgaattacacctaa

SEQ ID NO: 889 - DNA, 742 bp, Homo sapiens
attttttggttttaagttggaaactaattttacatatattcctataagactctgtcttatgggattttaaggttccactcagataactgtattagattaattctcaggagcaggaatagtgtcaccagatattaaaaagcaagtttctgtgcatatgttgacccaaaccataataatatcattattatttgtagacttcctaggattgcagaaagcctgtcacacatctgcataattcatctggacctgtatccctcttcctaaaaataattgttaatatcacagaaaaggtcactgaccccaacccaattagagaatttagacaaataagttcacttatctaagcatttactgaagttgctctccgataaaacctaagaatttcttagccacaagaatatctaatctgggacaggcaaaagtcacttggagtcaaatttatccttaagtgccagctgcaacatattctaatgggtgataacaccctacaacagtaacgtccttgcagtggacattcatgggctggaagtggctggatgtgcatgagctctgagaaggaggagattttgtctaaagttcctataccacaccctaggtgatataagttatgtacctgatgacaaaggctactcatggaaatgcaaaagtgagagttaaaataaaaagatatagacaaaagtccaaggattttactcaacaaatacttattgattgagagtcagctacctgccagacacactgt

SEQ ID NO: 890 - DNA, 594 bp, Homo sapiens
catcacatgggggccaagccaggaaaagcagagactgcaccaaaaaaagctcaattgcagaggagaagaatatcatgcatgacaaagccacatggcaggaagcaagggaaaagtcaacaactaagagcagagatattgggggatgatgatgcagtagtcgagagagcagccgatgagcacattaactgacagagccggcctggagttttagatgctggccctgttcccattcctctgcctctccgattcctaagagagtagaatctccataagacaagcagccaggacagattccagactctgacattcagactacttcagtacctataatgtttggatgtgagaaaaaacttggctcattaagtgccatattctacacaataacaattctgtatggtaataaattatcctgcatagtactattgcatttcaattgaatgtataactacataggagagaagctaattatccatgggtattaaagatggttgtttaaaaaggcattagaaaactaagtagaaaaattagaagacgaagttcataaacatgttctgattcaaccagccatcaaattaatataacccatcttcggca

SEQ ID NO: 891 - DNA, 52 bp, Homo sapiens
agacttgaaactaaacatcatgcccctaatcctataaccctatataggcata

SEQ ID NO: 892 - DNA, 1078 bp, Homo sapiens
tgctggatattttaagacatcacatcacaaaacacgcacacaggcacactgaatctaagtattaaagaggagagatctatactcctatggaccggaaactgtaggagtgcaaagggaagaattcagactagtaaataataaacactgtcatcaatcaagcaatttaagtgttttcttttattttgctcctgcacgtttgtaagtgtgtatgtgttcatctacctcatgtagattccctccatctcaagtggcagaaccaatgaattaatccaggtttcttattccagaaaattactatatctttacttatatcaccatattcaaacaacaccccctagaacaacctggaagctgaggtcagttgtcaataatttctactatattaacatccaaccaattctatatagcttttgcctgaccatttgctgaattacaagcaaaaggttaattgtatgtcatttttccagtcttactttctctttgcacagaacagttggctccatctgatggccttaactaaatgaatccacctttgactttcattaaatgcactgaaattaaactcaccaaagctcaataaacttttcagatatttcaaaagacaactcttcttaatttcatttctaaaactctaaatgaatacattcccctctgttctacagctgggaatctatagataacgaatcctataatctactctaatgataactcagaaacagagccaaagaccttaaattcataacactgaacttaataatgaaaggagagttgacattcagcctttctttggttttagactcagctaataaaattacaaataatatataattcccatgtgctcaattaactcttagtaagcctttaagctttgcatatgtgagatggcaaggttctttcctacatctatttttgagatattttagcatattacaattaagtgttctttgttaatttttttatgcacctaggaaattatagaaagattctgatgacttagtaccccacaaatttaacccttctggtatcagtacagattaagaactctattagtcaataataattcattcagcatcatgac

SEQ ID NO: 893 - DNA, 1262 bp, Homo sapiens
tgtcagcatcatgagtttaatgaagcaaaacatttcctgagtcagtatgggagtaaaaaacaaataaatatgcaccatatgccatacctatagttatagccttctcagttcagagagatgacaaggagacattgaaagttaacaaaagccaaagactgatgtctttttctcattaaaaaatctagtggtagaacttagactccaaagacatattttgtaaaggttcatcagcattacttaggaacacctctatgtagcacacatggatagcctagtctactttgaactctgccttctatgaactcctgaagcagatatacccctaatttcatttaggtaaaaatttaagttaccctgacagtagggaaaaataataattaagggtgggggactataagaaagaaattgttttcacatcataagctttcccagtaggcaaaaatgatgaaaatttctactgtgttttcaacccaatagtccatatatatgtccagaagcagggaacctacagcaacagtcccaagaaaaattactttccctgatggtaacattcacagtctaaaaggaaaagagcagcagcaatagtcatcagtagctccaagcaaatccttctttctatttgaaatgtcaataggccacctacagctaagcctatgaatcaaccagacttccattctgtttggctgcataaggacctatatatgttaacacagtgaaacagttcaattcacttttttcagcaaattgcagataactgagatgaaaatgctttaggattggggagtgagtacaagatggaggcctactattggtatagctacttcaattcttcatttcacattgccaacaaatatttgaaattgtgaaggagcctccctttcaccttcctcttaccatgaggagtatccttaaaggaaaaggaaaaatagattaatctgtatgttttcaaaattcttcctaaggtagattcacggttcagttttacaatcaacgtagcacatgttgtccatccagcaacagaattcacacaataaattgctatctgacatatggagtatgaagtgaattgcttttttttctttataggtatcctgatcagaatttaaagatttttcagaaacaaagaccttcgtgaggtcacaggtagccctttgttgagtcttttcagtcccagtaactatatacaacttaatacaataaataatctcaacggaatatttagacattgtcaaagattgtgtatgtacaatactgcattgcta

SEQ ID NO: 894 - DNA, 640 bp, Homo sapiens
cattgttagttgaggggcacataaataagtaatatcaccacagccacatatgaggaatatacataacaagcagcctgcctctctttaaaacaaaacaattatagaaagctaagaattccaaatcgctcttcagcaactgagaaatgtaactcatggtcactgtgagcagtggctagaactgacacattttgatcactaaattgtgttatggtgggagtcccctcctccccattaatagccagtgtttccaattttgctaatgctttactgacatcacaagcaaagtgaaaatgactaaagacaatgcatgagtcccttgagcaagcatctgagaaacaaatagcaataactccttattagcatgacttttagccatggattataagtaatgagtaacagatgtctgatctggtgtccctttattacattatcttaagggaaattcaggtttattttcaagctattcttaggtcaggtattgtaaggcaagaaaagtatttttattagtgggaaagaaatgtttttctagatgaaccaagtaacaaagagaagaatgaaaacttaacaagagtgctcaacccacacagaagaaagaagctttttacctggaatatgctggaatatggggggaaaaaaaact

SEQ ID NO: 895 - DNA, 405 bp, Homo sapiens
gcccaagaataaaatgtattactgcctcttctacagcacaggaatattatgagaactgatagatgtcaataagtgaaaaaggaagaacacagttaggttaaaaaaaatcaaatgaaaaatgaaactattttagttttaccatttttcacgtagttacaaaatacagtggtatttttgtgttccctctttgtttcttgttatctctctttccacccaccacttcccacaacaaattgagggggaggggtggtaattgaaacttccgttaaatcagtcccatggaaatggagcatggcaaaccaatactaaccacagaggaaaaaaaacttaaatgttttaatttggatgtgaaaatttctcatttaatgaaactcatgagtataattggatgctgagtcaatgagc

SEQ ID NO: 896 - DNA, 59 bp, Homo sapiens
gttgaaaaatataatgtaataaactgttaaattctaagacattttagaaagtaagagaa

SEQ ID NO: 897 - DNA, 152 bp, Homo sapiens
tgcaaatattgctagagatacaataatgtaaaaataatggatagaggtatcataaattattgctacataatagaaattatatgcagaatagttatatgtaattactcataattattaatggttaatagttggtggatgataattagaaatcc

SEQ ID NO: 898 - DNA, 56 bp, Homo sapiens
ttgaattaaaaaaatttttaattcttggaacaggaccttgtgtctaaatgtctaac

SEQ ID NO: 899 - DNA, 70 bp, Homo sapiens
gaagatgattatggtaccacatgttaaatttggtggtaaagctaagttacagtaagtagtggatatttac

SEQ ID NO: 900 - DNA, 36 bp, Homo sapiens
ctccatcacttttttcattcccaaaagttttattcg

SEQ ID NO: 901 - DNA, 146 bp, Homo sapiens
ttaaattgtacaataaatacaaattaaaaagtagacattatgggaagtgattataatagtagtttttctttcttttatataaaataatgcttagacactatgacttaattcatctctctaacaccagcataggttgagtctaatac

SEQ ID NO: 902 - DNA, 806 bp, Homo sapiens
tttttcacaaattatttaaaaatctgaaaactgaaacaccaccaagcctattatttcggaataataaatggttgtgtgtaggagtacaatacagtagcccttcagcaaatgtttgccaaatgaaaaaataggcctgtcttccttctcttcactccataaaagatggacttctcaaaccacaaccttcaccactacccacacacacacccttgtactaccaaatctcagttcattcctcatctgtattatgctaaaaatctcagggtgaaaatatgtcaaatgttcattatggaaattaggtttctccaagaaagggtaggcacaagacccaatacagcgactgtccattttgaagcaaggaacacatactattctcaaattggaaaaaaatatgagaactaggaggacagttaaagtaaatatagaagaagttgtatgactttgtatatctaagctttggtttcataagcgtttggtcagataatatgtaaggtcctcttcagttgtcgcattctcttagcccgtgtaggatgctgacagtcattgggtgctcagaaaatagaatctagaagtagcagggaatgtgtcaaagcacaatagtaaacaaacgttaaaaaaaacctattccatactgacaaagatgaagctagactgcatcattcatatggcccaaggagatatctaaagagaaaaataatgaatagatatagatgaaagaataattctctccatttgtggggctatcaaagttacacagaatgtatgattactgatgctattacagttttaatactaaaaagtagatc

SEQ ID NO: 903 - DNA, 2211 bp, Homo sapiens
cagaaaatattttagtgaggaggtcacacgctattttcttaaatgaaaaatatcatttttacatatttcttaagaaactaaaacatctttggttcaattaagagtgtgattttccaatatgtcagaaattatggcatttctacaaaaatattccaagaccatacctgatgcatttgtcacaaatgcaagccactcaaaaactcacatcgtcttcattaagaatgcaaataagtcaaaaagtaattgtttccacaatggcctataaataattttagtttaagtgaattatttacgaattgaaaatgaaattaccagtctattttctcttagtcactgtacctatttttccttcgctggcataaacttattatgttacacaagtgaagggtctccacgctaaattcagccatactacctcacttgtatgctactatgacagaagaaaaagcagatgaacctagttagagtcagacttattaactagagtgggtgttacatttgatttttcctattcaaccaaaaagttcctcacatcttcagcaaaatcccacatacacatgcccctacctcttcccctatggtcctcaatggtttccttgtaaaccacacccttcctgatgatgtggagatgtcttgggtcacccaccaccaatactcaacacacacacacacgcacatacatgtcacagaaagtaagccttcatcaaagttagaaaaaacattttcttttagacatatttatcatgttttatatttttcacaaatgctacactgaggcttcagtggctgttaaagatgactacaaggctggactttgatcaaataaaaaggcctgaattgtgacttggggtgtacttctcatttcattttcccccatgacaagccaaatgcatatcctgcatctgaaattatgtctgacttctctaaaccctaccaccaatgttaatagctgggtcaaatgttcaagctttgctttttagatcaaaggaagtttagaagcaaatggaactaacctcggagattacaaaataaaggacactcatttataaaattcaaaatatacgctaccatggttctagttgcatttttgagtatcagtgtatttcttcagtattgcccacagaatcaaagagctggtagagactttgaaaagtcaccaagccacgcttcaggttctgatggcattatacccttagtaggctaagaaaagaaaatctacctcaccaaacaagtagccccatcttctttttttgtcctatcttcagaactcaaagcctccccagttcattagatccttcagaatacaattaaacctcttttgttttgttttagcttcaaataaaaacacctggtaacatttgcataataaccctattagctaaaattattaatgaatataaacaataataaggcacagaaactgaggctatggaaggagagaagtatgcatgtttgccatgaaagccagcatcatttttggacttaattccatagtaactataagataaaagtttggatttgttcttattttttcctttttttgctaagatctcctttctatcattctccttcattgaggggggcaggggagaaggatgacaaatgttaggtaagagtcttggactttcccaagaaagaggaaatcatgaagtcaccaatggttagaacatttctctgctaaatgtgttcaattgctgtggaaatcctgtcaccttccctgctctccagtaaattaatcccaacttcctgctcagtgaaccagttgtcagtggagaagagggaagcagtgttactgaagccagccttccagggtgagccaacaatgtctagttctcagggctttgatccctttcacttgctatatctaaaggtcccacagagtgcttttagataggctttcaacgccatgataaaagagcaacgtgttcagtaacagttatcaaaattaggtcaagactgagactggcaccaggcccacttcacatccagctctcacccacccagaatgtggcagtgctgtctcctactccccaccctaactctcccataggtttgaaaatttgcctcccttactcaaaaaggtagcacatctaaggtaaaacttttaagtaaaatctcctttcatgagcaatgaatatagttctattcaactgcatagggttttctcagcattttaatatctagaccacaatcactgtttattggctcatt

SEQ ID NO: 904 - DNA, 769 bp, Homo sapiens
cattctgtaacaaaatccctttcctctcttttacaaaaatctatatttcacttggatcaacactattcacaggtttccattaagaatgagaataatctatcttcctttaaaaaaaaggtcagatactaaaaatgtacaactcatttctctctctgttgaacaacaaatagaatatagatgggcttttcccctttggctttctaattgatattgttaaattcataaagagaaatgaatagactactcttcacatgtaagggttatattgtttactcaccatcaatagaatacaaattaggagagttttttaaacataacaaaactttttttttcttgtctcattttatggtgacatccatattctttctcattccactttcctcatcagcaagaaatgtatatatctgtaaagagagtttactgtacttgagaaggaatcagaatccaaccgaccccaaagtgttctcaagtaccttacctagggtgtctcaaaagcaaaataaaaaatgtatcctgcaatgaacaacgtatagcactgtctcaattcttcctgaattctttgtaaagattcagcttgcattttcaaccctaatccattttcttaactttacaatcccaatcccttcctgaattctgactatactttccacatgtaggatgtgtctcactgtctttctagacagtcttctctccttaattctttattaaattctgctgctctgattttttgttagtgcaacttatccaggatgttggcttggatgtggaa

SEQ ID NO: 905 - DNA, 500 bp, Homo sapiens
ttctctcccacatgatggtctcattgacaacttcatgcaagtctggaaggaaagggcaactgccaaggttagtatataataagagtcctgaaatccagggagatcaggtttccaggacaggaaaccaagcactgcaatccacaaatgactgcagggtctggaaattgagggtcaattgcctagacaaggagtctgagtaacaggtatagaaaactaaaagcaagtaggattgccatacctagtcattccgttttgtcattccctgtgcactcatggcctttctataaaacaggaagccgttctcaagctcatgtggcctggctggagcggcaagtgacaagcacaaagcagagcagcatgtgcaacttgctctggcccctgccctgtgtaacagcataataaagaacttagtggatcaaccaatagtcgatgttctcctgctgttagtcacatgagggcattgtgcaagatgaaggtcatcttctaccacaatgacgtct

SEQ ID NO: 906 - DNA, 78 bp, Homo sapiens
aggggaaaaaaacagtttgttaagcatcaatatgtagtaaataggaggctaccattcttgaacacatttcatcttcac

SEQ ID NO: 907 - DNA, 324 bp, Homo sapiens
ttagttgtcaggggagcagagatgagcacagacatgacagacggatacgtctgactttcaatcaccttcctgcttcctgttcacccgcctactcagtaacacaaaaagagcctccctggccaagatggtagccttagaacatgctatgatctctccttcccaccccaaattcctagaaattacaaaatagcttgttgaaacttagaggaagaatcctcagtaaacctcaaattcagggaaactattaggaatccttcaaagataggagacagcacctaaacaaagaagggacataaagctgcaaacacccagaggcacagactg

SEQ ID NO: 908 - DNA, 26 bp, Homo sapiens
tgctgactcattgacctactacctga

SEQ ID NO: 909 - DNA, 87 bp, Homo sapiens
gcacttgatattttttgaatcagtatgtgaccaagaattgaaaaatagttccagataagaaagatatcaaggcaattcactacacta

SEQ ID NO: 910 - DNA, 502 bp, Homo sapiens
gttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatact

SEQ ID NO: 911 - DNA, 586 bp, Homo sapiens
aaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactccctt

SEQ ID NO: 912 - DNA, 771 bp, Homo sapiens
gacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatct

SEQ ID NO: 913 - DNA, 136 bp, Homo sapiens
tttatacttgttttgaagataactcaaactggaatcgatcacaagacacggaaagtacagtaacattatttcaaatgctacaaactcagttttttaaataagatatgagaaatggactaaatttctttcctctggg

SEQ ID NO: 914 - DNA, 220 bp, Homo sapiens
ctaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatac

SEQ ID NO: 915 - DNA, 346 bp, Homo sapiens
gtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgt

SEQ ID NO: 916 - DNA, 558 bp, Homo sapiens
ccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaa

SEQ ID NO: 917 - DNA, 681 bp, Homo sapiens
atctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggt

SEQ ID NO: 918 - DNA, 1772 bp, Homo sapiens
gccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacatta

SEQ ID NO: 919 - DNA, 521 bp, Homo sapiens
tgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccagg

SEQ ID NO: 920 - DNA, 247 bp, Homo sapiens
agaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactc

SEQ ID NO: 921 - DNA, 1969 bp, Homo sapiens
gtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaa

SEQ ID NO: 922 - DNA, 561 bp, Homo sapiens
actgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctggg

SEQ ID NO: 923 - DNA, 511 bp, Homo sapiens
ttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttc

SEQ ID NO: 924 - DNA, 117 bp, Homo sapiens
taagaaataaaaggtttttggatgatgaacgggctcgagccaatttggaccctctaaagctaagttgagccaggctgaacccatgtagccagaatcatactggattaggctgttcta

SEQ ID NO: 925 - DNA, 1477 bp, Homo sapiens
cccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtag

SEQ ID NO: 926 - DNA, 35 bp, Homo sapiens
ggaaattttatttggctagtcgtaactttaagttt

SEQ ID NO: 927 - DNA, 111 bp, Homo sapiens
ttaggggaaagggtttttagggggaatttatgctgattcccaattgttatccccacccctctatcttatctctttgcgcaatcataaatgatggcaggaactactccattc

SEQ ID NO: 928 - DNA, 373 bp, Homo sapiens
gacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagattttt

SEQ ID NO: 929 - DNA, 884 bp, Homo sapiens
gtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatcca

SEQ ID NO: 930 - DNA, 221 bp, Homo sapiens
cttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccg

SEQ ID NO: 931 - DNA, 238 bp, Homo sapiens
tgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtct

SEQ ID NO: 932 - DNA, 2107 bp, Homo sapiens
ctaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcag

SEQ ID NO: 933 - DNA, 151 bp, Homo sapiens
gaggttgccagattaatccagtacacacttctttaatcccgtagtaaattttctctttatagccaattcccaaagtcaagtatattgactcataaaaataccttctgggaagcatgtgactgatttccagctgagaggccctgccactgga

SEQ ID NO: 934 - DNA, 2071 bp, Homo sapiens
atgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagc

SEQ ID NO: 935 - DNA, 47 bp, Homo sapiens
ggcttatctattcaaaggaatataggagaaaggttggcggagaatga

SEQ ID NO: 936 - DNA, 116 bp, Homo sapiens
acttacacggtagatagtggcacaacaataaagcagtaaattagaatggagaatccagaaacacaggagaaacactcagaacacagcagctacttaacccatgacaaacctgccaa

SEQ ID NO: 937 - DNA, 78 bp, Homo sapiens
aactcagggactcattatgaaaaacaaatgacacttccatcactcaggtaatcccaagagttttaggaacttggagct

SEQ ID NO: 938 - DNA, 480 bp, Homo sapiens
gtggcattaaaaaattatgattctgcattattgccctggtttgtttctggtctttgacattgcatcatgctccaccttctctataggcagggttggattatggttctgggttttctgatttggaagtttaggtgatgttacattgttagaattagaaagtaattgagatttttgggcattttgaaacttggacatttcttataacacattcttttgtgtttgtgaagttgtttcttatagttggaaagtgaaatttgactgcaaaggccaggacattctgcttcatgactattaatgatgtcaataaatctggttcagaggactttttatttataaatactgaatccaggaataggctatggataattaatgaaataaagcagaagtagccttcttggctgagtgagggaaatatttgtgtaaattttcaagagaggaaccatgaagtattagactggaagggagctagtgaagtggcta

SEQ ID NO: 939 - DNA, 503 bp, Homo sapiens
cttggaggccaaataacctcagacagggtggctggaaaccagaaacttagccaggcctcctcctagattgctcctcctgcccctgccccatggggcgcttcctatggggcttttcccatggagatagatatagtgtcaggaccatgaaaaacatgatttttcttttctggaaagtgagaagttttgctgtgattctatcattctgtggacatttagaaagaaaagcaggatgtgatgactgggtacacaccataaaatatcttcttccttccgtatgaaacatcaatatcttacttggtgatttcttcttctcttcaatctaaaaaaaatctatttgagtaatttttaaaatttaaaatgtacagtgtattaaagaaaatttgtgaaaagtacatacaaagaagagggaaaataattataatcattaaaaccattgctaatatttaggtatcagtatcatgaaaaatggtttcccttttctgggaagttgtagaaagtatatc

SEQ ID NO: 940 - DNA, 85 bp, Homo sapiens
tatttttttttttttccccgtttaacattatcacacaagcattgttttgttgctgttgagacatattgttctaaagatcatagag

SEQ ID NO: 941 - DNA, 103 bp, Homo sapiens
gtgagccaccatgcccagccaatattaatgtatgtgtatagtagagacttttataaaatacataaaagcagaagaaatcaaaatcactcattattctaaaacc

SEQ ID NO: 942 - DNA, 59 bp, Homo sapiens
cttacatagttgagagaatattgcatttctaatttgtatcctgatcatgatgtaaacat

SEQ ID NO: 943 - DNA, 2076 bp, Homo sapiens
tatatattgtttatgaacataattttaaaagacttcagaaatcatcttgtgttccatattttagttaacctttccccagtgttttgatatttgcattgctctctgcccccatattaaagtggtgacctgagccttccctggcccgtgtggagcctgcatttttttttttctgtccccaggacataattagccctaatccacaaaccaattagtagaggggtgaccagattatgaatacatttgtgaaaaacatctttgtagtggtttttcttcttcagtattagaggttatttccttagattagattcctagaaatggaaatgcagggtcaaagggtaagtttccagaagggttttattgactctagactcctggaaacactgtatgagcctgtcctacttaccgtgggcctccaaatccccttcctacagctctaggttgcttctcagatctgaaatattgaagaagttgtcggggcaccaaaactctggaattaagttaatcttaacagcccctcagctcctctttcccattccctattatttttccccctctccaaggcctttctttctttttgtagctcctctgccctgccagctttctctaatccccttgtgcaggcttcctcttctccagtcgggaggatggaaatgatataattaagtcattttattaagtagttagtaaccttagcagctagaagtgttagtccccagctggacacttgcattttaataaagggttcttggagcagtggtgaaccctaagaactggacttgacggtaggatttggggcactgtcatacccagggagggagatatcatgagccggagccactcaaggtttacaagtagatggagtcctggatgtcaggccagctttgtgtgtggggtaaagcaaaggtcagtctttgagaagccttaatttcctctctgccaaagcactaactgctgagagtagaaacaggttttcttaaaggtaaagtgagtctctcggaggaactattaaggagaaattgtttactgaattggatgtaataaaagactagtcagcagcatatacagattccttccataaaatataactttatgataccaggcagggctccttttatggctttctaaaatcgtttggttgaaattgctagaggtgtggagggccttcacttgtgtgtcggtagccagtgatttgattacattatatttccctgggcaagcagagccaggaggcctctggatgggggctgaggccttgattgccctggtgggtactctgagttgcagaaggtgggtttcttgctagacggtttctgtttcaacaaggtctcaggtgccttttactgcaaggaatgttgtaggtctctaattgtggactcgtatatcagttttaatggactgaaaatccacagaaagcactggggagtgtgcctccgtggagaatgggccaacagctggatacaaccagatggtgccctagatcttacggatggacaaggatgggtacagacaggttattaggaaggacttaaagagttggggaacctgattcaaacaaagtcctcgatagcctgaacgtaggcggaaggggagaaatggtaagtgtagtcaactgatagctaccaattgggtgctctcaggagaccttgggaccacagccagtggggaaagtggtcttgagagatgatggggaccagctggagcgggccagatgccggcctcccttcctcctggaaagaaaacgcttcagtcccacgatggtttctaccttggcactcacagccctgtctcttcccttccagcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgaggtaagcctccccttttgagggcctgg

SEQ ID NO: 944 - DNA, 154 bp, Homo sapiens
tctggggttggatatgactatcaagcaatgggtcttcatatgttcaggttagggcttctcctgggcacagaaagcagcctatccagaaggactgggaggaagtggagggaaagagagagggagaacagatctcttggcttttagtgttctcctc

SEQ ID NO: 945 - DNA, 1133 bp, Homo sapiens
ctctcccagtgccaacctcctgcccagaggaaaatcaatggccactgcacttgcctatctgttcctgtctggagaagggatgatgagttggggagcaggaaggcctctggaaagctgtcagtgggcttagaaatttaaatgcaagggcagattataagggagaaaaggtagctgacactaggagggaagactgagtaaggcgctgtctcacaaaaaacatgttaagattgtccaaaagcttcagaaaaatattcaagatttttggtggtttgcctaatgtttcctgtggaactaggcatgtactggttgggagctgtatccttgggaggaaaaagcaaaatggatcaggtgcctgtttcagggggaggacaggacaaggaagacatactccttttcaagatttgtccccagcagggaatgatgttaaccagggccatgatttgagaggaaactagggggcagtctctatcattttcctttttaaagtgacgtctgttcaattcaggaacctcactttaaatgacagtggtctgagagctgtgtcaggtggctactgtttctggtatatgttgtattttagctaatgcgtgggcgggtctcccagtcaggcttctctttgtaaggagactggctcttctgggacctgggcacaattcaggcggccagaatcaagtttgtcctgccccgtgaggaagtacaggacaggaatttctggaaggagctgccagagccccaggcttggtactttccctgctgagtctgatttagtgatagctggagctgatgttcatagtctaaaaataaaatctgagcttgtatttttgctcctcttactgttcaagatagactggccattgatgagctctcataaatggagacctctgtcttcctccctcttggatcacattattgcttgtagggagattgcaaagtcattcctggtgtcctcttcacctctctgtgggttttggcagtgctggccagctactttgaggcattttggcaatattgagagctcttggtccccagtctactctaagtggattggaattcttagaggccattaaacaaatctgccctttgcccctatgtccagaacttttacaactaacttagatcaagaatggactgtt

SEQ ID NO: 946 - DNA, 1625 bp, Homo sapiens
ggaccatctgaagcaagaaaactccagaagatagtgaaagtttgggtatgcattgcattgtggagtaggatctggtacttattgtctttggtgtaaaatctctgagtctctgagaaagtagaagaagggctgttcaggaaacacagccctcactgggcttgggaaacacagttggaagttaatgaagtttagaggacctctggaaggggctgtaaactttccagacttaccactgtctccacatgctcctgaggaaccatatctaggctgctgggcttaatttttaaaatatttgttcacatgaagtatccataatatgtgtgtagatatgcacgtgcatataacatgtacatattaaacaccaaatcaactttcagcaatacataatgcagtggtcactaaagatagtttatagcttttctgatgatcttggaagaattcttgtgtggagtgactgtccttcagagcttaccataataggagacgcctaatagacggagctaactttgtggagacttttccatacgatgctctaaaggtcaggagggagtgattgaaagaatctagcccatactgttagctatgaccccttttgatcagtgtcaaattgcaataaatcttcaaatactttgtttctcagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaaggtaaccactgaggcctttagattttttgttaatctgacagcttgtattaatatgcagccatcttaaactggatagccttgtgttgaaagagcggtatatatgcatgtgtgtgcatgaacgtatgtgtgttgaatactacacaagatggcagggtatgtggtaagtggaggatagatggaaggactgagtgatattgagttaataaacaactaagataagtatttgttgaacacccactgtgcaccctattgcttagtatactatcttgcacctgaatgtttatcagaccatttgtttatacgttgctacatgttaaaatagcaagcaccttcctccttctctttttctgaagcaatcagattttctaccggtcgcctagcctcccagaacaataggatgctggaaaatatccatccagccaccctggggggcgctctaccagaactgtaggggaatcctgtgactctgaggttcatgccagcgctaaggagaattgttgctggagcttgaggctcacaactgctcagcaccttttagaagtctcccaccctcaccactcaggggtcaaagcttttcagcagtggccgccccatgtttgactgaggtgataagagcaggatggtggaaggcctgctcagaagccatctgcagctttcttttcccccacctgctgctgagcccagggcaggggcaggcagtgcagccaccgtgctctgacctgttccaggctcctgtggtttttggactcacaaggtgttattggtcttaatcctctgccccttcccccttcaactgggactctggcattttcacg

SEQ ID NO: 947 - DNA, 106 bp, Homo sapiens
caaaaaataaaaaaataaaaaaaacacaaaaagaaaaaaagagtacctgctgtatagcatttatgatccttggctttctggcctccattcattcattctacaaata

SEQ ID NO: 948 - DNA, 201 bp, Homo sapiens
ataggttggtatttacatagtccatggccaaggagttctctgataagttaactcttcatctttttagacacgtgggttatatgaaagttctgtcttcactgagccagaatccaccttcctgtaactttttttgtattctttcttggacacccaggatgttattgtttttaatacacttaatacctttcttaatacttttat

SEQ ID NO: 949 - DNA, 485 bp, Homo sapiens
ggcttttgtcctgttactagttcagaactttcttatttttctcaatgtctccgggagaccagactgaattacactcaagattgttctcaatcacaaggttgagcttggtggctctcttaccttgccagtctcctgaacacagggccaggagacctctctcatatcacacacagcatctctttggtacagcagggcctgcctcattgtttggaccccttcaagctacaggaagagctttagagccttcggtggttgggttcatgctcatctcaaggaccatatactttactcatctcttgggaatgacaggcactactaggtgttctcactgctgagtcctacctattactcctaaggttagacacttaggaaagctgtagtgtcttgttttagggcagagaagttggtgcaatgtagtgggactttcttccaagattttatgaagcaaaacgacttcatagccagatatcagaaatacacatgac

SEQ ID NO: 950 - DNA, 42 bp, Homo sapiens
tatctgttattcacaggtggtttcatataagttcaaagtttt

SEQ ID NO: 951 - DNA, 44 bp, Homo sapiens
cgggggtgtgtttgtctgaaacacatctcaaggccctgtgtaga

SEQ ID NO: 952 - DNA, 27 bp, Homo sapiens
aaaagaatacataaaaaggaaaaggat

SEQ ID NO: 953 - DNA, 40 bp, Homo sapiens
gcttatcatctgtgaacctatgttggtgctccttttcctc

SEQ ID NO: 954 - DNA, 619 bp, Homo sapiens
taaaaaattactatgaaatgtctatttagtagttgagtctagagttttgcaaaggattaatagcctatttactaagatgttcgtgtcagagtttacgtcttctgacccctgtgtaatatgagaatacttgcagatattcagccttctggcaaggtctacactgttgtgcgtaactgctcaaaagtcttgtctataagcttttgctgttcctgggggtttaggtcatctgacctgaaaacttgaactcattcaaaaggcttgaggttttcttcttgctttcttgctatggagggtttattctctcttaatgattttttccccataatcttaagctggcatgtttttagtccttagacataatgaatattatgctctaataaaatagagcataatcaatattatttgcatcatgtttggtggtggcctgcacaaaccaaaagctcctcttgtttccagtggtcatatgtttcacctgtagatcatcactaccagaccccatgctagctcttacctaatatgcccggattgctcaacatggtttggccggccatttaacgggcctggtgccctttcctacagaagatggaatttcaatacatcatctttctttatttctttc

SEQ ID NO: 955 - DNA, 112 bp, Homo sapiens
tggccaagacatcatctttctatggataggcaaaacatacagatgaaaatgcttatattatcttccacttagagaaattgtacttttcacaagcaactgaaatcattcatct

SEQ ID NO: 956 - DNA, 519 bp, Homo sapiens
tcccggatgccagggcagggcctcttgactgcacgttacttcccttggctcctcagccagagccaagcactctcaggtcttggagtcctctctctccaactgcgattcgctcgggttgcttgctctgctctgccatttagtacaggatcatggtaatcaccacctgtttcttctttctgggctcctgagtctcactgcaatcatttcctaactccagttttctaggcaagttcttgtactttacggccactttgtttacactttttggcctaaacttgtcttcctctttgtcctaaacccacatttccatcatgctacttatgcatacaatacccgtatttgaagaagggacttttttcatcccatacaggtcattaaataagatcaggtacactatgtcatagcctttcaatgaccttgagattgctcaaaagagcaatctcccaattacgatattggtccaatccacatgacaggtcagacttgcttgggactcacatattacccaatagattttag

SEQ ID NO: 957 - DNA, 286 bp, Homo sapiens
taccccatagattttagacagtggattgtcttttaagattaggaagcccttctcttacctctcaatatgaaaaagtgttaatacaagcactgtacaaataattgtggcctctcactgtgtaaacacatagctgtctcaagctttctggggctaggcagcttacaaaatatttgtgaagcagtgaggtgtgaggcatagacggcagagggcatgatgggagtggacacgcatccctccctgccagtctgcccacctcccccagccccaagacattcagattaaaaaa

SEQ ID NO: 958 - DNA, 1262 bp, Homo sapiens
gaccacatggaaccacatctggggcctgagtcagtccttgagttgatgcttcttgagtcctggtctaaaataatgtctttttgtgttgcagatctcctaccgatatcttattattgctctcggaatccagctggactatgagaaggtaccgtgtgaaactgtttctgtgttacgctggcttatctatgccaagagcaaatgctgcatttagttgctttattatattcattttgacaagaaaggggttctaagaaaatctcttctggttttatttcttggcagtccttttacagttttaaggaagtcttctctaagattctgtcgataataaccatatgttctagctttaagctttaattagagttcagcatgctcatgccttaatgattaattcttgcaaaacagcagttttctttccacatttgtaagaaacatgtctttctatgtgggacagagttggctgtattgaagattacattccgctttggaagtagggtttagattataaattttaaagcagactttaaggggtggaacaccagcagttagctcgtctgttgctggagggacatctgggttttgttgtgtcgatactgggtttttagtgtgaagtaaccgatgcaatggaaatgccactcagaagttcctcagatccccgttttcagtgagctagggagccagatgcaatttgaaagttttgagattcaacttcatttttctaaaacatagcagagtaaatcggtaaatattatcatttccagaaggttgttggggactacagataaatagttggagtacaggaaacatctgtgctaaccgggtaacaagcttcaggaatgtgacctgggcaagggcctcaacagagttggcccagtaagaatctttgaagtgtgttgaattgtgtcatgtccaggggaagggtagtgaaaatgtcttgggttgtgttgtgggaaagttcagagaagctacaagttgttgtgaatgttgtaagatggttttgagtcatggtgccatgggtcgtgagtctgttagaatgacagacaagctatgaagtagacgatatggagaaaggtgtttattacaactactttcaagggggccataccttccaaaaaggcccccacagtgttgacctagcaaaggcaatgcgtctccatggtactgtcttcccaaagccccagtgtcatgtgagaagcactgcagaggccagtgctcagagttcatagcagcctcttgtagcaaaccaagtcacagagatattt

SEQ ID NO: 959 - DNA, 336 bp, Homo sapiens
tgtgctacttgggactctttgattgcaatttcaaggaaactactcaggttggtgtaaataaaaagtagagatcattgatgaaaatactgagatgtttctagaacactagggcaaggatgtagctgggcctctggcagggctggatctccactttgggttctgttggactcaggcagcctctctttgtccatctctcttagcctctttctcaggccagcttcacagggtctctgcagcaggccgtcctgcctgccggtctactctgtgtgataggatagtccacggctccccagtgcacagcctgttgctggaagccaaaggaggagtcacatctca

SEQ ID NO: 960 - DNA, 411 bp, Homo sapiens
gcttcagaattcccagggaagcaactctgactagatgaggggtcaaaaccaccctttttgacgcaggttttcctgaaaggagcttggttaccactttacggcaacttttccatcaacgacagcttcttaaaactagagaaaactaatgaaggtgataagacatcaactgcttgtttctgcttgtttatctcttggatagtgagatttgctttgggaactagaaggtatggcggtcctgtgcgaagacccccaggcaggtgggcagaggccttggtgtctggttctttaagattctgggcagggctccatccattctaggggttaatattcccctgcctccctcagaagtacatagtgaatatccattgttagcattgatgtgaaactttgaaaacatttaaatgcaaggtg

SEQ ID NO: 961 - DNA, 356 bp, Homo sapiens
gagactgccaatgttactactatctaactgtaacaggggtgaacagtaacaaatagttgcttttaacattgagtgtgataagtaatgaactcaggccactgaggagatgagaggactctgtttccttgagacctcagggataagtgtctggagtgactttggaggtggcccagagaatgggctggggaggctctgaaggaccaggccatcttgatgactgtttcttgatgattgaagttgaacctgctcttgctgagaactgaggcttaagtctctttaactcagtctgtgacatcttcattgcactctacgagccttctaacatttataataggtgtctagttgatcttattggc

SEQ ID NO: 962 - DNA, 998 bp, Homo sapiens
aggcacctggctttagtgcctttatctagagtttggtctggtacaacctgataaagagtgatttaagtttgctattcttgatgatataaatggctcttggtcctgccagttgttctttccagtgaggcaactgggtctcctaaaaggaaggctggctggcgtcttgtcctcactccgatggtgggaaaagttgtattcaaattgtattctcaaggccagggagttgaagggttcctctgagctgagcccattctgcagtttgacaggtgactacaggtgccacagctctggtcttagaaccctcacccacctgcctgctctaggcatgtgggtattggagggtaatgatagtactgaaatatttgaaaggttgtagaaatggcaaagaacaaggactctaaagacatttgcacttttgtttaaaataatttttgtgtactttgttgcagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaaggtatgcttcctttctggggacagagatgagcagggcggacagtgctaattcactgattgcaagaattccattttatctctattgtaatcccttttttatctcggaatttttattacatgtgtacaaaattagttaactggaagtttataaaatataaaagaggagaaaatcactcatgatccaattgctttaataaagctgcagttttcaatttgacatggctttccagctttttttctgtatacttaaatatggttacagtcatagtgtacatgaaaaatttagctgtattatgtaatattaaatagtctttgttacatactttttaaatgtgtgtgtaaaagtctactggat

SEQ ID NO: 963 - DNA, 928 bp, Homo sapiens
gtctactggagagatatgttagagactgtttaaatatttccatatagttagacaattagttgcagattgttcatttttatccataatgctatccactacttccactcaagtttaaggtcatgaatattttctgtcccttgggtatacattaaaaaaatatgatacggaaaatgccaatttaaaaagcaaaaaaatgttctcatagaactttaaaccttcatgaaaagagatatttgggcaggaggagactttctcagcattctccaaatgctctctgtgtaagagcagttgtctgcagctcaagtacacctggcttaagcttgtaagggaagctgttcttgccctccctgctcttgcctggggtttgacatttagtttaccaaagtgcggtttggcttgagacagtggcaggatttctagcagctagtcgtgtatggggacagatgggaagaagggtggggaagaacgggctggggagtggttgaatgtgctcatggaggctgggactgatcaagaccttcccctgagctctgtaaactgcaacaaccctgtgaggtagggaattaaaggcagttccagtaatcatttctgaccccaagaaagttcattctgggtcataaagggctggcacagccttttgagacacttacccacctgaattcttcaaatggtgagatccgggtgagcaaatcatgaaaggagccgagcaaaggaaagaagaagaaaccagctgtttcttccgtcctggaaacttctttgtgtaactcttttctcccaagtcttagatggcctacgaggaaggttcgagtaccataagatcttaggcatttgggagaatattggcctctctgatcttaggcatttgggagaatattggcctctctgaacaatatcaagaaggtaggaactcagggttttgttgttactg

SEQ ID NO: 964 - DNA, 965 bp, Homo sapiens
acatgaatatatgaataaacattccgttctactctactctgtcttgacctggacctaaccttcacctctggccttcagctggacagtgcccacctcagcccccaactcaagtgtgtacttagttgtatgtcatgggcagaacataaggaggaggcagtggattggtctacccattgctctgccaggacataatggtggcaaaagctagcaaggtccctgctgagggttttaattcttgtctggattaaaaaaaaaaaaggcagctgcagtcatgctttggtgtgaatggttttcttatttttctcagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcagtgagtggtgaggctaagctgtcagcatgaagcgttgtctgctgaaacgtgccatagatacatgggggctcacaccaccctatctgccatcattgtgtgctggggaagactgggtgaaatgagcatcttagggaagtgttagggcaagaaggtaggccaaaatggttggggaagagaaagatgtaagaggctgtgtcagtgggaggtgagaaggtgtcgttagctggtgccaagtgaatttttgtcctattcctttgactcaacttttcctggcatcgagtcacttgaggtagccaaaaatattccacaactttggttactgtgtagaggtaagggagggcttcctcgaatgcaagatctggtgattgtctcaattggtggcatgtgagaaacagtcctgcttgtgagcaggaagtaaccctgtgggtagttgaagaaaacagggatt

SEQ ID NO: 965 - DNA, 51 bp, Homo sapiens
tatctgcctttgtctatctatctatccatccatatctagtttttccaagga

SEQ ID NO: 966 - DNA, 129 bp, Homo sapiens
attcttctaaggggtttgtaattaaagaagatatttgtgtcccctttgaattataggatttcaggtcagatatttagttccactcttaaaatctgaatttcaaaaaatccaccagaaggatgtaaagct

SEQ ID NO: 967 - DNA, 63 bp, Homo sapiens
ataatagcattctatttttctttgtaaatgaacctgttccttcaagccagagattgtaagcat

SEQ ID NO: 968 - DNA, 116 bp, Homo sapiens
cacactgattggactatgtatgttaatgaaggaggaccaagttatttatcctatacagttacagaaataaatgatagataatgaacaagctacaactaagtgccagtgtttgtttg

SEQ ID NO: 969 - DNA, 42 bp, Homo sapiens
attaatttctaataaatccataaagtagacccttttgtagga

SEQ ID NO: 970 - DNA, 1479 bp, Homo sapiens
agtagatgatagctgttgaccatttcatccattatcctgcaaacatgcattcagtttcaacgttcatgaacagacctgacctcagggacccatgtgcccaagagccaccctccacccaaggttatcctgcagatgagcagcagccatttgcagtgctccttccctgaggttaattaagcttatatttgtctgagagttgtaataagtacaagtcatcttcctaattcccattgccatcagtgactgctgagcctctcggagggcatgggaacattggacttcttgtggaaatgaagggctattgactatctcaaaaggttggaattgtcttcaactgcttaagtttttaccctaatgacatgtcgtgaacatttcaatcaatgtgtccttaactggacccactagcaaattgatgaatttgctggaaggagtttgttaaaaataaataaaaagaataataagaaccaactacaaaacgtgaaagaatattacataaacaaaaaaattaaatgagccctcaaaagtgattaggatgggtcagtgcaccactaccaaaggtaaccttgatacggtgttttggaaaaaaattcacccctgccttctgcactgaaaagtaaatccagtactgaatcagaccccttgctccttttccaaagtgctagctaatatttttaccaccccttttcatcttaaattggtgttctgacagtttcctttatgtgttttgaagttgacacatatttgggaatgatgctttcttaccagctcctaacatatcctttacaagtttaagggatgctgagcatcaccttacagaataacgctgaggtgctaaactttgcaagttgacagctgagggtcagggagactgcaactgaaatataccacccccttattttagtactaataaaaacatcaatggattttttcagaatattagtgagctttactccaatatctcatgtacccgtacgtgtgtccacagggctctcttggtctctgtatggggagatcacgtcaactgagagaatggttatttagcttatcaccattccccaggagaacacataagatcttggagagggcgtggactggtacaagtgctgattgtataatgctccatgcagccatagcacagtgtatagagtaaggaaggtagggggagagcttgtggagctgtagaaatattgaataaatgaaaatgtggattctctctttgtgtgtagtatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtaggtaagtcaaccagctccatttctccctttctcaaaaatatgtcacctcaaggcatgattgtaacaaaaa

SEQ ID NO: 971 - DNA, 691 bp, Homo sapiens
gatttttaaataagtgatactcagtaaaaataaaactttaacaagtatgagaatttggtcagacaaccatatggttataacattacctaatggacatattactaacaactagatttagaaaaattagattcagagttcactaatcatgtaaacaagggatattatcatccacttataaaagaaacattttaaggtaattataaatacgaacttcataagaagtgagccaatctctgataatcttaaaaaaaaaaaaaaaaaaactaccataagtctttaccttgaaacctagcttgaccaagtcatgtcgttttaaggcagcatgagtacaggtcatagcaataattttggcttctttcactaaaaggtatttagatctgtccagtccacttcgaagcaattcagaggctctgaattcctatggaaacgaggagcaatgaaagataattttaggaaaacggagttttgcacataaccatacaatccagtcagacttaattcctgagaaattaacataaatatattataaactaagcctaatgaattataattctgttcattatgatttcggtactaattgagtttaaataatagctgatataaaagttataattcaaacttttttgtatgtaacgtaaaatatgtactatataaacaagaatactgaataaaattcagtgatcattgtacc

SEQ ID NO: 972 - DNA, 69 bp, Homo sapiens
agaacatcaaccatggcagaggatccccaacagagcagaaaagagtatggaaaaacaaaaaacatttgt

SEQ ID NO: 973 - DNA, 35 bp, Homo sapiens
tacctaccatccatccactcaaccatatacatttc

SEQ ID NO: 974 - DNA, 64 bp, Homo sapiens
agaataaggatccaatttatatcttacttaaaattaatctaatttctaagatttgaatattttg

SEQ ID NO: 975 - DNA, 938 bp, Homo sapiens
gatttgaatatttcacatttacttcaaaaaaaaactaaactaaattaaaaaccactaaagggaagttcaaagaacttgagaatccttacctcaagctgcgtaaagattttcttaatatgcctgaaacatccttcagcaatttccatgtcttcttcataagatcttcctttaaaaatgggttgaggagcatttgcaaagtattcatggaaagggaagaaagtggagacttccgtaacatctggcaatgtactacctttatttttcactttgctgatatactcttcccagcgagacattacctgtagaaaaaaggacttgaagttaactgccagctaattatgatgttttaaagcataaaatgaataaatcttataaaaacaagatctgctaggtgaaaaagaaaaaaaaagaaattcaatctttgatccaatataactattcttcattcctgtaactgacagattgctcttctgttataaaagtaaccttgtctttggagaaaaaaaggctctttaataacaaatttctacaaactggaaagagccttaacatcatctcatagaactctaactccgacagttcagattctccacgtaactcaagagagtttattattaacgcttaaaagaaatgtaaaggaaagaaagctctctggacaaagaaattgctcatttttttcatctctgtttctctccatatatggtaagttcagctttagcagctttttaatcaatttggcacttgtcaaccctctgtcagttttttagaacatttataaagaacgtctggttaagctgagtgtgtatttgaaagcttatcttatgacttttgtgattatagttcaattactttgtataatgttagctatgcgtctaccagccagttactatgtaacctcaatttctgtaactctcccaggtctttttctgttactatct

SEQ ID NO: 976 - DNA, 403 bp, Homo sapiens
taaatgttgaaaactgccaatttacactgtgaagcctcaagttcattcttcccaaatttattacataaaccttcttaatttataggttatttttcccacttttaaacattattttcactgaaagccaagtaattttgtgtcaaaaaagcatttaagctgatctttactcctttatgcaagtcctaaacagtcttgaatctaatgtagactatattatgtattttccctgcttcacaagaaaccatgaaagctgctcattttgaatggacttaattggtttgtgatatccacttacaatgagcttacaatattataatttatatctaaaatatacaattggcattagaacaaagagaacaaatgaagttatacaaaaatcttcattagccaattatgtcctagt

SEQ ID NO: 977 - DNA, 892 bp, Homo sapiens
aactgactattaaagtttagttttattcactttatttggctatttctcattggttttcacacttccaaaatttaccctaacaaaagtaaaagtacatctttatgttgaagtcagaagcctttaacttcaagacccactgtgcaattagttgtaagacataatttatttctggaaatttgaaggaagaatgttttccttcattagttgattaatgtatacaataaaagttaactgtactttgttgccactggctagctagaatatttatttagttgtatttctacagtaaaaaaagaaaaaagagtgactagaactttgccaatagaaagaaaaaaatgtaaaaagtagcaacattggtctttcacagaatgagtcatcaagcaaagttatttagaaaagaaaactgaagataatacaaaatacacttaacattcataaatatagcacttgcaataccatacattctaatctactcaaaaaaataagctttcatgaaggatcacaagaactcattccagcttccaactggggttcatattatgatgaagtatgattcaaaaacccttaatatcttacctggtataagaagaaatagcctgcagtttcacaggtatatgaggcatctcctggaacccctagactcttttgcaatcgtttgacttcttctaaaagttctattcttcgagccagaacataattaactcttccatacctagacatttcaattaggcaaaatgacaaaactgtaataaagagactttgaaggaaacaatcagcaaaattcaagaaaatcataatagcaaagaagaggaaaaaaaactagaagatatggcttctatttaactattggtggtagttcttgggttactttacacaaaagctacttaaagta

SEQ ID NO: 978 - DNA, 156 bp, Homo sapiens
tgcttcaaacagcactgttttacactacataaaagtagattagatctaaaggctttgaaaagtaatttttaaatgtttttgattatctctgtcatctacatatcccaatacataacttggcacccaaacctagcaggttcttaatgtttgctgaat

SEQ ID NO: 979 - DNA, 381 bp, Homo sapiens
acaacaaagggtctcccataaccctttaatgcttaaaataagactaaaataatttaatcaatcactgttgttcccatgtttaaagactcaacaaaagaagaagtcatgttcctagctgtctgtagttcagagattcacatttgaggtagcaagggatgattaagaacaaaaaagagatctaaaacatgatctatgcttgaagaatttttcaacttggaaggatataaacatatggcagataacttttttctgcttgcttatctataaacttttatctacaatgaacacttcgttaatgagaaaaaaatcaggaatgcttacagactctgttaataaaatgccaaaatttttgtgaagtaatgttaaacttaaaaagcaaca

SEQ ID NO: 980 - DNA, 93 bp, Homo sapiens
agcaatatacagtacaattaaactctactatctgctcaattagtacattattacacttaaaagataaagaattatttttaaaaagcaacataa

SEQ ID NO: 981 - DNA, 965 bp, Homo sapiens
gcaacataaaaattacaaataacagcattacagaaaaagactagcaaaaagttgttttaggatagtgtaattatggataaccactccttctctacaacttcaccagattttacaatttttttcttcagagaaagtgatgctacttttattgtgaaacaatagtcataatttttctttttaattgtaagagaaaaagaatatgtccaatcaaatatgcaaactaacaatatctaggttatgtgtcagaatttaaaagtacattttttctaacaaatttggtggtacctgaaatcattgtaaaaattctacccctattctaatattctttaaaaaccataaattcgacttcaatataattgtaattatagtcaaatattctattagcaccttcatgttcactgaattctgaattattagattttagagtctaacctacctttgtaagttggctttaaaatgaggaaatacctatgggatgaattcaaaagtattactggctaatctgaaattaagaatatagagccctaaataacttatggcatgttgttctttgcccctctgcaacatagtgactttttagaagctaagtgtttggtaagctctataatacaagaactcaaaatagatgcacataataatttaaaactcttttaatgtctatgatcaattcatcaaatatcatgtttaatagccaaaggctacattaaatatgtccagctgttaattgtgcttattatctaaaattgggctttaaaaatggatttaaatataaataaaatgagacattataaagcaactttgaatgaaaaaaattaaaatactaatggcagaagaaatccgacttgtaaagttttagtcaatttacagtatgtgatatcaaacaaagtccagccaaactggcaagaagcatctgaagttatacttataaccccaaagcttatattatcattaatcactaatttgca

SEQ ID NO: 982 - DNA, 2801 bp, Homo sapiens
taatttctatttcaataaataaatcaacctcctaattggcacctaaaatatatgcaaattaaattcctgaataagatgtgaaaaaggaatcatttaaagttgtacagttttgaactggcagcatgaaaaattacctcaataaatagaaagcaaaaggcaatctgttaaaaagattaacaagatcattctcttcattaacataattgtatatttgaagacaaaatggcataaccatacacaactggaactgagggacatcatgaccatatttctagctcaacatatagtcttagtaagttaagttagaacctttcagaattaagtttcagtattcattgctttcttcttctttaataaaagaaatgaaaagaaaataaaaaatccttttttacactgttactcactcccatttgctcacctgctgaaatctttctctgtctccagctcttcttctccatgaccaagacgcagtaggtggcgctcatcaatgtctaatgccatgattttctcaaacaactggtttagggcctagacaataaagcaagaagggtgacggcacctttaaacgtagcaaaaactaacatttagaaagaatcaaagttgaaacacagaaggaaatcagccttatattaggccatttataatttaatcaaatagtatttatattgatttctgatattgccatctatgtctatttggctgtatggataactagaaaccataaaaccacccacctattaaacatctgcttttaatttatgaaacgagaaaggcattggctcagatgctatttcttccgagttgtaacaactcctaaaataaacaaccacactgagtttcatttcattcaacagcatttccttgggttacagagaactgaaaaagtttttgcagttggagaaagacaataagaaggcagtgagtgtgttggtagaatacattaagaggaccagaaggtggaaacataaattgcatctttcaaatcttagtctgaaagtctaatgttctcaatataataaagagcagagcactcatttattgcaaactattctgatgaaagtcatttaaaagtcactactttctatctgtgaaatgttcataattagggttccctcgaatcctagtattcattatctgaacttccgcagttacaaggttttacagaaaggcaaaagtttcatagtatggaaagactcactaattaaggtactatttaaaaataagccgccattcaaacatctcactttcactagtccaaccctgcctgtgaagtcagcatccagtcttataaacacctaggttatataatgtagatacagatatcctttaccatcaaaattctagcaatctgagctctgaaactgaagagatttaacataaattttcagaaaaatcccccactatccaaactcttgatactcatcatccaaaactcagtacccaacagagcagattacatggtgttactcactatccaaaccttcactattcaaactcaagaaccacatagattgaataaaagtaaaaacaaaaaacaaaacccccacaaacttgcacactataatcccagaaaaaactacatgatttcattgtgaattacagtgattttgaagaactacttgaattatacatgcaaatgaagatctggcaaacaaaacagttaactgaaggaaaacaatcaattcgatgggcatcaagggaaatgatttgaatttcaaaaaaccaaggcaggtgtttagcaagcagtgaattatgtgtctatttttgcaaattaatcttttcaatgattgtgctatacaaatcaatcataaagtagaggataactgtagaaagccatatcaaggtatgacaaaacagtaaaaaatatgttaaaacaacacatgaattattctgttcattttaagaatttacaataggtttttacagaacaaattttataaacagaagaaaaaaacttcttttcataatttgtttcttttatcaagacaaagtccaaattgatcccccttcaactcccacaaattcagtatattagatgcattatgtccaatatgttatgtaatatgttattatataattatgtataacatatattcagtatattggataagtttactatttataaacttcaaaatatataaaaatatgtcaggcaaatgaactgaagagtattatttttaaaactttacaaattaaaagttaatgatcaccagagtaactgatatttggcattccaaaaacacagtgcttctgtatataccaactcaaagactggtcaactgaagtcaccactgttaacataaactccgagaaaaaactttcagaggttttgactaccatgcaaatttcataatatgcttcaggatgttctcagagttgcctgtctcattttataccagatctaataaatgttacttgttcttccctcatttctgacagcttcagaatgactaaagtagaatacagtcccttcatgtaatacaggtgtacatttcacatggatttgaaatttaatccagtatcaatgcactttagaccttagtctttcaggaatattcattctactaaatgaagaaaaatgctcccagtaagggttaatgcttataatctccaagtaaaagttctagtttagtgtagaaggaaaaaatagcaatttaatttaatccaaatatctaaccatatatccaaatagtcttagctttttcacattgaccctctccagtagaaataaaagattgcttttatatatctctcaatgtcatctcattataagcagtgataatccaagagtagctcaatag

SEQ ID NO: 983 - DNA, 234 bp, Homo sapiens
aaacagaatggttgtatgggtacttgaagtacaatttctgctgaattcatattgctttcacaccatcataaagtcaaaatattacaggtcagaataaaagtcaaaccaaaagtcagggaccatctatactaattagcctttcctggtattttgtggtacctatgatcagattttcatacaaggataaatcatctattaatacattcatttcatgaatcctctgctccttcctta

SEQ ID NO: 984 - DNA, 137 bp, Homo sapiens
gaacaggtaggccaggctcagaaaaatggagaacaaagaataatgaaactagatttcttgaagaggaacttattgtgtcccacacttacctccccctcaacccctaacctgcatacccatgtgcatgcgcatgcgtg

SEQ ID NO: 985 - DNA, 258 bp, Homo sapiens
gtcatttacctgattggaatgagtaacaattagagtcctctgttctgggaagttgtggtagatgttggatatgatctgaactgccacatctgttttgcctgtaccaggtgggcccacaacctaaaaagaagatgaacacatagcaaactactaagtcatcacagttatcacacattgttagaaaacgtgaagtacagacctgaaagataaaattaacaaattcagtagatgggcccaataacagaatgaacaggatag

SEQ ID NO: 986 - DNA, 153 bp, Homo sapiens
gcgagcagcaagatctctaaatgcataagaacctacacttacttgtaaacgcttaaattcagcggggttgctgtacttgaaatagaacgcattctaaaatctgttacttacttctagtcttaatctatgttaaaaaaaaaaaaaaaaaggtgt

SEQ ID NO: 987 - DNA, 848 bp, Homo sapiens
ggtgtaacaattctcttaccatagtcagcccaggctgcattccagcacggatggcttctatctgtgtatgagtgaactgaatcgtattactgcaaataagagtaaataaaaagttggtacagataaatgatgctttgtataatacaaatttagacaacaatgaccagtggtctaaatatctgctctgtatttaccccagttctctcaatctcttctgaatgactcccttcacctctacccctcaacacagacaattaaaatggaattatagttatttttcgggacttagcccatcccagacctcatttggagtgccaaagttctagtttccattctaatactaaatataatgccaatttactagttatggcacacatgcattagggctactgctatatgtaacacaggctcatgaagtaagaaccctttgctcaaattaaggtagacctctaacatttatttctcatagtacctgaaaatgtttctttttgaaatattatgactacagaatggcctaaaatgtcagttattcagctgactgacagaatagaaagaaagagggttcagaaacaggagttttgtggagttttaaaagaaacagaaaatttaaaaacattcctaatccagttgaaatggcaaactattgttcatcattacaattataataggtagtaaaattaccgtttgggttgattataaggataaggacccctattaggaataacatggggctcaacaattaaggtttttgcttcctcggtgtcttcatcttccacatccgcatctttccttttcttcccttttccacttcttactggaaaagttatcctacaagaccaaaacttctg

SEQ ID NO: 988 - DNA, 225 bp, Homo sapiens
atgcacgataatcagaggagtaagaaacatttctggcttaaaggaacgatatctgtatgtaaactctgaaaatggtcgagttacaagccctaacgtgtgttgggagttttcaaatttaaaaaagtcacccagttaacggagaattacgggagaatttaaagaaacattaaatattatctcatgtgcattgtaaagtgttttattcattgtctgtccttcatttaa

SEQ ID NO: 989 - DNA, 120 bp, Homo sapiens
caagtacaagcagcgtatttcgcctgggcatagggtagagaaaaataaggctgaagagacagaagccttgttatgacaggaaccttataatgacatgtctagaatatgaagcttttaagg

SEQ ID NO: 990 - DNA, 257 bp, Homo sapiens
tccagttgtctttcacattctaaaaaaatagataacaccaaagaatgctaagagccaatgaggctaagtggtcagcacttattttggtaagaaataggagcatatcagctttttagctaggcagtgaatagctctagcagtaaaccatgtaatggattctagtgaggtgagacagggaggaaagattttgctatcataaagactgctgagggcctaaagagggagcagtacaaatggcacatgaaaaaactatcctc

SEQ ID NO: 991 - DNA, 175 bp, Homo sapiens
tccaaaaaactatcctcaaggcagaatctctgagatatagcaggagttttatgggagtaaaaagattcaaaaataatgctgagatttcaagatgcaggagtagaaaaatgtctttgccataaataggattaggaaagtatggagggagactaggtttgggtgtataaaggatacg

SEQ ID NO: 992 - DNA, 199 bp, Homo sapiens
cagttgaaagctgtgtgttttctaatttctaggcaagaaagtaatctgtgggctaccacccataggtatactcagtgccttaccactaatccatatgaaggaattcagggaataacaaccaattatttcaggtactttgttctgttttcacttaaattttaagaccagacctaatttaagattaaatatgactattgta

SEQ ID NO: 993 - DNA, 1487 bp, Homo sapiens
atattatgaacatttcaaatttgtgaaagcacgcaaagttaaaagaaaaaaagatttttttcctaaaaacaaagttcaacatcacacagctgcattagttgagaaacataccagactatgcataactgccaagacatattttagtcaaatgctataaatatatttatatagttctcttcagacaataagtatttattgatcccttattaggtattagactacttttactgtggtcttaaaacaacttctgcagtaagaaatagattcaaatataataaagttatcccagtgattgtatggtgaaggtagggactgctaaaacaaaatccaaatatagtactcaaaactcactttagctaacaatcctgatggcataacgtacattgactacagaatgctggagaggagcgtacccagttctgactttacctgaaagggggtatttgtagagcagggtcttctacagttactttaacattatgaccagggaagctggcttttaaatgctcaatggagagaaatgtatcattgaaatcaagggtggcaatctgattgggcattttcgaataatgtgcactacttgggtccccataacctaaaatgatatcgtgcagccagtcaggtaccacacaatcagtattcatcaggttccgaatagtctccagcacagcctgtcagtaaaaggacagaaaaagattgtgtcagtatgacatctccaacatttgcacttactggaatgcagagctggctgcactaatccagaattcccgagtgtttcagagcaagaagctattttccgctggctgacaggtgcttggctagactgaatcaacagctatattttcagctgataccacacactgagttaaacaaaagaccaaacttagcaagaacagtttatccgttaagagttcgcttagacagaatgacataaataaatttaccatttgactcctattgagtaggatgaaaaccagactcaggtggacacagcagtaaaaaaaacaatatagaacaaacccttaaagaaaatacttcctctcagtaactcctggaatttttccctctttatattccatagttctttaatgctaaagtcacccacaaccagaagcacattaatgtatgcttcaattgtgatgaaacgtcacaacttagaaatattaaaattaagactgtgagaagaaataaaaaagcgaacaaaatgataaaaataaaggaaatatcaaataaaatttcagaaggaaagaatcaggactacaacaaaaggtcattatagtagttagcatatatgctgtcaaaaataattacaaaaagccaagggaaattcttagactttccaaaaatcatttcaacaaagtgagctatctcacatatagaaatttggaggctaggctattaatttcaaagaataaaataaccaaaccgaccatttttaaatcataactgttatacaacttttgaaaacgataagatagtatatgtta

SEQ ID NO: 994 - DNA, 63 bp, Homo sapiens
tctagaacagtttaaatatggaatgggtgaatgaatgaatacccaaatgagtatattcaccta

SEQ ID NO: 995 - DNA, 365 bp, Homo sapiens
ttattgaactcaagtaaaagatttgtgaaggagctttgatttatttcatcatgaatagaaagtcaaagaaatgttctgagagggagagtaaaatgatcagtgtcacacagtaggaggaaacatgaaaaacaggtgactggctatgaggagactcaagggtagacaaagaggaggctactataactgtctaggcaaaaaataaagtatccagattaggacaggttgtacaaactggaaaagagaaaaggcaataaatgagagatgctacacagatacataatgaaacaccaaagaaaccaaaagagcattctttttttcctaaacataggcaagttaatcattccccctctttcttggatcagaaa

SEQ ID NO: 996 - DNA, 117 bp, Homo sapiens
ataagaaaacaatgttttagttttcagtgaagtaactgagatttatttactgaaaactgaccaactgtgacagtcaaaggtactataaaacttggaaactcttagatttctccatcc

SEQ ID NO: 997 - DNA, 1193 bp, Homo sapiens
aacaagttctgctgttcaaaagattttcttaaaaaatcacaacaacagggttacataaaagtaataaaatgataggaatgtctaagaagtactgcactttgggagaaagagaaaagaaaggcactctttctgcaaaagctacatgtatcaaatgctagaactgttcaatgtttaagttttataatatagtttcaaataatggtttttaaaactatcctttactaaaactcttctccccacaaagttattctaaaagtagaactttgagccaccaaacctccctttcctactaatgagtaaaaatatattataacgtatagtaattcagagccttgagattccatatctgtattcttaaagtgacctggaagtatacctacttttgattcaaaaaagaagccccagtaaacaagtaagcaagttttcttcacttcataatagggcattaactgaatacctaatatacaaaaagcaaaaaaggaggtggacctttagaataacacttggattcatctatattttaagtttttaaactcctcaaaagacaaaatagatttaagaaatcaatttctttaaatttttatatttcatcattttgttaaaagtttaagaggattgcttatagtaaaaataaaagcagtcattatttttttcttaacaaatcttcctctaaccaaatatctctgtatttatgtcataaaagttacttaaattatgacatagtacttttagttacatacccccaaattaccttaaagttattttcctttggttttctcctcattattatattaaaagtttcatacacatcctctgctccattttgtatagtattggtcatatcttgttgatactggtttggatccaaaaacactctaaatgtccttgattctcctctaagattgggtctgggttcaggtcctggacaatttgaaaaagtttgttaaataaaatatgtatttttcaaatatcaaaataagttaacagtatttcttttctagaaatggtgagtaaatggttcaggcttaactccaaccattcttcccaaagtagaatgccctccactcacccacttcaaattctaagatgctgaaagtattttcttctttctctaaattcttactatttccttccatagcagtcatgtaatgtttacgatgcaacaccatgacttgcaataatttgtacacaca

SEQ ID NO: 998 - DNA, 559 bp, Homo sapiens
atatgtattttagaatttaaggcatagttttctattcattaattccttaatttgacagaggttcatcacttttctcatccttccacattccatacctagtataaccagcatgaaaagaaatttcacatacacagaaatgtaggatactaatggttgaaagcccagagccttttctttcctctctgacatatctcctcttttttggggggggtggggggaagggggggtcttagacctcgaactttggttccattatgtggccttatgcttattccatccattttccattcccttctcctatttcctctcattctagagataaataacttaatcatcagcagtttagcaatgatataatctctaaaccacagatagcataaactgactaaagtttcaaaagaagtacaacaaccaaattgtaaaataagcactagacatgtatgcagttgtaatttaataataagtattataaaggaagtcaggacaacagaagaaagaatttcaaagggataataagtgatacacataagaaatcaaataactgactaattttgtaaag

SEQ ID NO: 999 - DNA, 172 bp, Homo sapiens
cactacaatgaattaaaatagtcaaatttaagaagaaaaaatatatcattgaacacaaaaaagcttggacaactgtaagagatatttagagtgtttcttaaaaaaaatatggtaaagtattacatattttaaaaagctttgaataaagatgatttcaaaagatcctgtccca

SEQ ID NO: 1000 - DNA, 44 bp, Homo sapiens
gatcctgtcctttccaatatctaacatagaagttctgaaactgt

SEQ ID NO: 1001 - DNA, 1808 bp, Homo sapiens
aaccatgttacctatatctaaaactgcacggtaggtaccctacacatatttgatacaaaatcctttgtgtcaatttagtaggtaaaagaactaaaaaatattacctaagaagcaaaaagggaaaaaggcaaagaaatttatcattctatacacatactctttcaaaaatataggtcaccataccatcttcaatgacacgtcctttatcatccagcatgccctgaatttcacagcctctgacataaaccaggccaacctgctcaataaaaggtctcctccggtcaaacttagtgccataaggttttgtgggacgtacggtaattaaaaagcatacatcatgcttacgaagacctggtaagatataaagacattttcatttattagaatttcattgttttcagtcttttgtaggcaaattcttatttgcctctctacctcttatctttggtagagagataccgttgagtgaccaatgattattatcgcattgtaacacaattatgggcttttctataatctttaatactcaatatttcatagcattaattgaaatgaaaacttctttatattaaaattagaaacattcatgccatgaatatattactgaataagccctccaagtcatgctacagctccaaaattggatgttcgtcatcattcttatttttaacaatcttaataagtaaccaaaaatatggctggcatataatccatctatagcatatttagcaggtttttaatatcagtttaaactatctatcagtgtcattccaaagacagcctaattgtatttcactaaaacaggtcaactcaagaataattaatcaaggcaaaaaagtattgtttacaggtatgatcttgagaaagatggctgaatatatacagtttcagttggcaaatcgtgaacatttttataagtgaatgtcaagaaaaaggagacttgtgccagagtccacagcttcttggtcactagacccaataaagaactcaaatggcttcccagctctattaaaagtagagaaactggaagacaaggattataaaattagacctcacagcatgtaatgctacaccacttaatcttcattccatttctgatgtttttgttagccattacatgacataaatgtaaatgtaaacagtctgcttgctcacaaccttgttaacaacaaacacaatgaaatcaaatcaacaatgtgggcatatggctaatagtactgaaaatattttggtttgttttaattgggggactggttagagtatgggtaaaggtagaaataataactctattcataatactgacttaattatttcccaataaattctatgcaaagcagcaagagaagtaatgagaatgaatgggaatcatcctactctctgagttgtactacctgtgtgatgtctgatctgcacagctcattaaaacttctaagtcttacagccaaagaagtggtcctgagaagtcatttatcctctcccaagataggagttactttttggcatcactgagggatgacctcttgttccttcctaaaacaaaccactttactctgggacatcttagatccacattttttaaaatcctatatgtctctctccttgcaaccatttgtatccaccctatcctagctgtgctttctggagcaaatctggcatttccatttcatgaattctgtttccttaactttaaatgagaatattgaagaagataagggcttgaggttcacaccttttcaaagggacaaaaggaatgttttatggtatttagtttaataatctttaaaatttacttttataaaacaatattc

SEQ ID NO: 1002 - DNA, 282 bp, Homo sapiens
tgtattattgtttacagaatctctcctttttactccattttctatttggctaccctatctgtgatcaatataggggctggtttttggcccaggcctcccataaaacacttttctctccatcataccccagattatcactcatcccacaataccctattgtgccctatcttgcccatcaaaatgtaccctgtccagttctcattctaccagaggctgatgtttaaaagaaaaaaagactgtctcatgtccttctgaaagcagtcagtaatgggggaagtggcc

SEQ ID NO: 1003 - DNA, 1780 bp, Homo sapiens
aagcttcaaggaataataaatatgagaccttctccagcaacttaatggctttctcgaggctcagcaataataaaggtgcacattagtctagatgagtaatataccaggatggaactcttttgaaggatacaagggttataaaacaatctgtcataaactatacccgctacagtaggcatttgttaaacatttggctagctttgttgctggattccttcagaattctttgatatagttcccatgattataaacagctacactggtagtaataatttctgaaaacagatccattaagggacatcctttccttctggcatgccaagaaggtaaaaggaggtaaaacctactgactactgtttctcaaaacagggctttaagtaagacctctcacaggacagctgggagaaaaatataaaactgcctattagaaatcagttcatatgtcacttctggcagaggtcttattgatgttttaactctattggacttagtaattttgaacatatctgcctccaaaacaaattaattttgacatggaactctaatccttaaaatcttgcctagcaaaaataggaggaataactcctttaatttctttgcaattattatatatccttgactacatttgacttcactgactctttatcctttctgccttaggcgcaaataaactattatttatttctgaattgtttcactatagccctgcccacccccacatattctttttaagcttgcctaatttttattttccacaaagtgtatgtatttctatttttttcaccttggctacttttatcttttgaaaaataccaattttccttactgctctgcatgtttgtatgttatatgtgggctttctccctgctctttggtgaacactaatatttttattcttttatattgatgccagaaatccataaatattattttgctaaatttaagacttaaaatgctctcctctaggctttgcaaacttcagttttcaaaacgttgatatgtatgcaattttatactttttattaaagtattaagatacctaaatattcttgtatgatccctggtatttttaaaactaataattagaaaaaaagttgctattctttaaatcaaatttcaaggataacgcttaataaaagctttaaaggataacatttagtaaaagtactttgttaatgctctaagtgaaagttcataacaaggcaaaaggtaatgtcactttttgaaatacaaacttaccttcccattcatctttgatgtgatctctgacattgagatttatggtaacatctgcacgaactcgggttggccagttttcacctatgttgggtttggccacttcaacgacagtgaaagccacaatgggctgggccattcgcgcccaaccaccaaacactacaccgccatattcagattgcctgaaaccaaagaaatggatgattactcaaacaaaaaataatttatccccaacttttagacaagttaaaactagtaagtaggaatactgttcagctagtatttaagtcctaatattagtaactcttatttcttaacttaaaaaaaagaaaacctttaactctcaaagtatgcaaagtatataagatagcatgaaacagggatatgatagcatgaaacaggcaaacatggtccagaaaagaaagagaagtagaggaatatctcctctccaacctaagaaaaaagctaaccctatgtacataagagcattctggggctgagccattttatcaaagaaataaataatccagcacacttagtttta

SEQ ID NO: 1004 - DNA, 700 bp, Homo sapiens
taaggcagtctagtggtcataaactctctcagtttttgttctcttctgtttttctgtctttatttctctttcatttctgaaggacctctttacttagttttattttatattgttatccttttatcctcttcataaagaccatttcaattgttaatattttattttctatattttaagtatttctataagctgtttcaaatacattttaggacaagctataatttcaaaaaaaattaaaaacaagcaaacaaagaatatctatgtaaaaacctcctttagagcatatttaaatcatttaaaagatgttgctatggattggaaggaaaaaaaaaaacaagctagttgtaataaacagaaccactaacatcccaatgcccattctttcttcttatgtcagtctaacgagtctttagtttttatattaaaaagttgtatttgggaaatacgtaacataaaaactgaagcaacactccaaagttatgaagtactgcagaatacaacatacctacaaagataaactgcctcctatgtaaagactttatgtcacaacaaaaaattgtagcacttcataacattaaaaagagaaactaattaaaaacaaaattctgcaatcaatggcttggttagtattgggacaatgtctaaaaggaattacttagtggctaaacccttgtgaaacaacttcctatcacctcctcca

SEQ ID NO: 1005 - DNA, 333 bp, Homo sapiens
cctcttacccctttctcttcttataaaatctacttgaagcattaaaaagtatagatttctggcccttaagcacatcctctcttactgctggttagtgggcttcagcaccctgaaaacataatcattggaaccatgtaatgagtaaaaatgcctctgctggttttcatcttcaagatacatgaaacagaaagaagcctggcccccttttaggtttcgacatttttaataattttcaatgatgggcattaaaaatgtaaatttagaaaaatctattattaccagtgtgaatgaattaactccaagaagtgacattttcttccccagccagaaaat

SEQ ID NO: 1006 - DNA, 1615 bp, Homo sapiens
cagaccaaaagaactcaaagtatttttgttgcacttggcatttaagtaaaatataaatgaattctatttgttgaactgccagttaataaatcgctagtctgcaaaatggccaaaattaggcccagaatctgagcatataaactcaaggtaaccataaattgtaaagaagttttctgatcaagcactcccctagggtgcaaacaatgggcaacaatttcagcaaagctgtgggcaggaatgatcagccagtgggtatacaaatttcacagtgtttgcctgcctactgactcaactgattattaagtcaaaaatgctttgtgttgtattttatagtctcacccagaataacttttcacataacaattaattaaaaaatagaactctctatgaaataaaacatggaagtgaaaaaatagatcataatcacagtgtctgtggtagctctccataattagtaagcagaagcctggaagatacctgaatcagttcacattccaaagctgttcagcttttcacataaaatgcagtataatcgtgtatgtatacatggtgtcctattatataatgtaataaaaatccatctcatagtattttactcatttataatcacttgtgatgtataacttacatccatcaatttcatacttgatgaaattgtgaatgaaatagtgaataaagagcatttgcctcaagtcagccatatctataaaaccaaattaaccttacaaattcttgtaatgcagagctgctacaattaccagaatgaaagacttttcttagctaaaggaatttcagacatgagctagcaggtggggagtggagtttatgcagaagaattcctcaaataacaagaccaactcaactggccctaaaagtaaatcctggtgatttactttcttccacagaatctatgggtagagagacagagattttctaatgtaccaccccgggcaatgtgcagcaacagccctaatcctctgtccattcccctagagaggctgcctgagaatactgtggcaacagtgacaagagtaggtggattaatggtacacccctttatcataagcttcctccaggacttaaactgttctgacctagtacgggcctgcttggccaacccctagccttccaatcggcctttaagtaaggtctgacctactccctctacatttcccccttcccttcttgagcatgacgacttcttctcccttatccccagtctcccactcccattcccaagtacccagatatgtggtttatattttagcacttttgatgtatgttaattcacatttaaaaatgtctcaaagagtaaatatctcctattttagagggcacttttgtctcagtatattatttctaaatatacttataaggtttctgacagaagtttatcagtcactgtttgcatctcttcattacaggtggaaccaatttactaaccatggcttcattctgctgacactatcttcaatgtcctgacgaatttcataagttgattctaagcggaagaggttaaagttccttagcaggtagtcatgaagagtcaaaaactgcaaattcaatttgggaagagcaagacaacctgaaaaggaaaaaaacatccatatttcaa

SEQ ID NO: 1007 - DNA, 66 bp, Homo sapiens
accgcacccggcctgaattattcttttaatcagatatttgttctctgtattaaaaaactggcacct

SEQ ID NO: 1008 - DNA, 81 bp, Homo sapiens
cttcccatatcagacttttgtttgtgtgtgtgttaaaataggcataacataaaatgtaccatttcaaccatttttaagtaa

SEQ ID NO: 1009 - DNA, 87 bp, Homo sapiens
ttctacttttttatattgtgctcttatatactatgtgaatactttgtcatgtccatattactttcattattttaaaaacctcatctg

SEQ ID NO: 1010 - DNA, 387 bp, Homo sapiens
aaaaccctcatctgttatcctttcttattttaaggaaaggtatttttaaaccaaaataataataatctgaaactaaaagacaggctttctgaaaggacagtttgtgccctcgcctgacatacctatggacaggcgtggggccgtccttgtggtctttgttatgttgcagcctagcaaaaatgggagcactgggcagagcatggtgctgacaggacccagggtatagcccctggcagattccctgatttcttgcgttggccataaggaagagtaggtaacaacgttggttgtgaatattctctagtgtgtgtcttggagtcgggtagacctggcttctgaacctcagttttctaatctttggaaaggcggctgggcgcggtggctcat

SEQ ID NO: 1011 - DNA, 1047 bp, Homo sapiens
tcacctccagctggtgaatggtggttactaactcggagtgcttgtttaaagagtagccaagcattggggattcagaaggagcgaaatgaactgaaacaaccaaaggttgtccaggtgatcctgtgggcatatatattgtgtgtaaatagactctcacagccttcagaaaatcttctgcctctagctatgaccttagtcaaccccatgtcacatgaggccacctggggctaatgtccatgaatgtctatgatcttggtcctctgggaccaagaacaaagaagagtttgacccacaaactgaccaccaggcgatcttccctctcgaaaccaaacttggaagcctcctctgaaacttgtattagtcacactcctggtcagagaaagtaagccaagtctcccttctgcagccacttagcagtcctggatccagtcagaggactcttgtcagtcttgttttcctggggcaacttccagaatactcctgccttcctaatgctctctcttccccttccccacagtattcatgggctgccctgggcaagagccagctctgtttagcactgataatgatgacttcactgtgcggaatggcgagacagtccaggtaaaataccatgtccacctgcaggacaaaagaaagatgttctctgtgcatgcccaaattgctggccaggagcccttggttgctgtggccattgtgagccaagtcagcccttcagaggaggtagtgttagtcctcagctgtccacagcttgggtgtgagcactgatctaaggggggtagtgcttgcagctacccaacagtggtgcctgaggtcaggccagtggagccaagagctgccttgtgagtaatcacccactgtactgagtccctcggattccctctcccaccttcctttacttccttcccttatcatccatgttaaccccaactgaaagcagctctaaatgcaggcctgccaatcccatgagcctccaggaagatacatctggggtgcttggccacacttcgttttaatttttgaatagctaatatagccacatggttc

SEQ ID NO: 1012 - DNA, 202 bp, Homo sapiens
gctatacaataaataatctccccttgtttgcctccatttgcccaaagcccccttcaccccttcacgcagttaaccactgttcccagtttctttccttccagagtttatatatagtctatacttacatgtgttacatatttatttatattgtacatgtttttacatgttacctatttcgtatatatacatatataaaaacaga

SEQ ID NO: 1013 - DNA, 131 bp, Homo sapiens
agcacagcacaatgtctaccctctttccacagatagccactattagtttttttctgtattctccctgacttcatccatgtacaagaaaatatgactatatggtcttatttcctacccttttacacaaaagg

SEQ ID NO: 1014 - DNA, 58 bp, Homo sapiens
ataagtaaacaccgagtttcccttgcaataggctcatctaggtctcctcacccttaac

SEQ ID NO: 1015 - DNA, 937 bp, Homo sapiens
acccttttaactcttataggtgagaggatgttgagcatgtcccagctatttgcacatctgggttaaggagtttctctccttgcaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcaggtacgactgtgccttctcctgggaagcattggtggctccagggacccccatccaaaggcctgcatgagatttcttgctactgaatgtgggggctgagacagaaaaacctctcctgttcagtgagcagattctcctatggcagtgcccctcttcacagaggactctttgtcacagtcatgggatatttgttactttgtcagctgccattttcttttccctccagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgaggcaagtagcctttagtgtctactgtaaatgtcccctcagaagtgggatcctaggcctggtgaggtgggtggcaccgggctgaccccagagctgtgtaccccacagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtaagaggactgggaaggggactgctacggggctgggcccacacccttaaatgctaaaagatcccaccatacctgattt

SEQ ID NO: 1016 - DNA, 47 bp, Homo sapiens
cacagggaatgcagcaaagactggagtgttagaacatggctgatgga

SEQ ID NO: 1017 - DNA, 673 bp, Homo sapiens
gaaaaaaagagttccagaagtagacagggctggagttggaactgggaggaaaagatactcatcccttctctccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaagtgagtggcccttagggaaagtactgcctacccagacttgcccaggctgggaactgactctgagagcagaagctcctatccctgcccacaaagcccaaggcagaacagtgaggacccacgtcagctgggatggccactgctgggttcacatgccatgcccctggttccttgggcctgtggcccgctgccagccaatctcgttaaatctcctccagggctgggaggcagctgtaaaatgcctacttttggtattttctgtaggttttctcatttcctctcagagtggctcacttagtgtgcacattacccaaattggtcccttatgtgccacaaagtagaattagctccatggatactggatttgctgcctgtttcctaattgatacctttatccaaatcctcactcaaaactctttttctga

SEQ ID NO: 1018 - DNA, 476 bp, Homo sapiens
gcaagactcattctggagcagttaagggtcagggggcgatgccaaggcttccctaggacaggcccaggagaactatttggatcactcgttccctctccaacagcatcctctgcttctgttctcctggcagtgggtgaggggtggtcaaggagtcagcgttatgatagggagagatcctcctctccatccacacacccatgagccagtgcttcctggaggtcaggggagggacccttcagattaaactcacaatgggcttcccctctcctttctccccagaaagtccctgagtacacactgaccatccaggccacagacatggatggggacggctccaccaccacggcagtggcagtagtggagatccttgatgccaatgacaatgctcccatgtttgacccccagaaggtaatgccccttcctcactcagtccctcatcagataatgaaggaccaaagtttgcctttctcaggaaa

SEQ ID NO: 1019 - DNA, 54 bp, Homo sapiens
gatttgaaaacatattttccttgtacctacacctgcccatcttttcccagtgaa

SEQ ID NO: 1020 - DNA, 1103 bp, Homo sapiens
ttttttgttccgagcaactgattttccagtctttgtcacatgtcccagaacctccaaaaaatttctgttcagtgccccagcccattcaggcacctagcccttcttgccaccttccttattcctttctgatctcagctggatagatagctacacgtggcaggggcttgggcatgcaaacccgtgagatttctggaacatcaggcccctgcgtgtagggaaagcaggcacaggattggtgtggtctgtgccagcagctgtgaggctgctgctggggacatcctgccgctgtgtataccctgaaaccccgcaaagtgggtgggtggtccaggaaagggtaaaggcatggggatcccctgaggttggatggaggcttctcagcctctggagtaggacagtcattctctgctctgatagtgctgtgcttctcacactgacagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaaggtgagtcagttcgggcctcagacaatggctatacctggggcagtcaggtctgcagccttcaggatgaggagccactgtctaccgtgggctagtccaggaatcgtaccagcccagtggctcccaacactgttctaccactcttgtgttgggaagtccctttgttcaaactaaatcttacccaggagcccacttcataaataggtaagagtcactgattaattgaagcacatcagtggagcctcctcccagaccacagtgtccaatggctgccccgaatcagtctcacatagagagtccatcttattgaaatccatgttgactttgcatttactctaaaactcatgtctaggtgtttagataataaaatgttttgaatcactgaggcacactcttgcctctcaaaaagtctcttttttgtgtgtatgtatttttgtttttattggggtataggacgtgggttgggtcaaaaagtctgaataa

SEQ ID NO: 1021 - DNA, 133 bp, Homo sapiens
tgaagatgggcctaatcttgcatcagtttcttttacttcctggtttactatgaagaatggtgtggtttgagaagcagggtataaaatattgtatgaaataatatattttaaagactggggtttgctgtcctgt

SEQ ID NO: 1022 - DNA, 133 bp, Homo sapiens
tcgacattgttaaatgatgtgaaatgaagttcatttataatataactaacctaactcattatttctaaaaatagagaatgtcctaactaaaataaagaaaaaatccagaccgggtgctgtggctcacgcctgt

SEQ ID NO: 1023 - DNA, 47 bp, Homo sapiens
gaaaatccagcctggacaacatggagaaaaaaaaaaaaaaagaaaat

SEQ ID NO: 1024 - DNA, 1214 bp, Homo sapiens
cccccagttttctcaaacatcaccaccactccactgggaaccattgatctagggcttattaatacagttacttttaggatggtctgagaggccccattagatgtgcactcaggaaacacgggagtgtttatgttacagagaaagggcagcactgttgctagtgagggcctcaagcccctcagtattggtgttttccttctcacatctcaactgtcctgcacaggacctcctctcaaaatggtggtccaggtccttcttcctcttctctcctagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcaggtactcaggagctgggctcagtaagcagcacgtactggtacagttggtgggtgggtgatcatggccaacgtttgttctgattaccatagagattgttaaataggaatatccctcctgcataggttctcttcttcctaccctctttgaggctgaagactgaataggggtttgggggcaggtatttctcactctgtcatgtatccctcctgggactcctgcacctgctgctttaggtccccgtttatgggcgaggtgcattttccatatgatcctgcttaggagcccagaggccatctgccagttggtatgaggaggccctgaatgatgacatcagaattctaaatattctggatgtactcgtctcaacttttcctctccagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggtgagagcatcctcccagccctcccacaagggccacttttggttctcaggtcacatgacacagcacagcatgtttcctccacaggtgggaacatgtgtcgaggagggctatttgcaaaccaatccagacggtcaaaggggtctttcagaggagtcttttaaagactggtccta

SEQ ID NO: 1025 - DNA, 58 bp, Homo sapiens
ctgatcctagggactggccatgattccaatttccctaaaacccaagagttgggaggga

SEQ ID NO: 1026 - DNA, 646 bp, Homo sapiens
ttagctgagtgtgccgcctcccagttcccgcatcagtggcctgcacagggcccttggggcgaattgcagcacgcctcggggcgagcggcaagggctggggtgagtgcacctgcacccaggcggtcttttcacgtgtcgccagggtcagaccgcatgtctctccttgcggcgctacacaagagcagagtacgagtctgaggtggagggagtcatggcaggacaagcatttagaaagtttcttccactctttgaccgagtattggttgaaaggagcgccgctgaaactgtaaccaaaggaggcattatgggtccagaaaaatctcaaggaaaagtattgcagcaacagtagttgctgttggatcggattctaaaggaaagggtggagggattcaaccagttagcgtgaaagttggagataaagttcttcttccagaatatggaggcaccaaagtagttctagatgacaaggattatctcctatttagggatggtgacattcttggaaagtacgtagactgaaataagtcactattggaatggcatcaacgtgaagctgcccattccactgaagttctgaaacctttcatcatgtaaataatttccatatttctctcttataataaactaatgataactaatgaccaaa

SEQ ID NO: 1027 - DNA, 337 bp, Homo sapiens
catcagcattaggaaagtcccttcagccttagtttttggttcactgggtcctgaattggcctgtcagttttcccttgtgattgattgataggggctgactggaaagtgccatgacagattagtgatgccacaccataacagatgggaggttatgacgtagttgtcacctctggttgacatgtaatgaaccaggacctgcaggcaggtgagaggttgcagcagggctgtgaagggaagcttccctgaagctgatcgacaaacactggagtaaccctgaagtagccggtaggtttcgccttgtggttatagtggctgtctggatgaagtggctgcaact

SEQ ID NO: 1028 - DNA, 533 bp, Homo sapiens
gtattggaagcaagggcatggaaggtcttgagaggtgagagctgggcggtaaacaggaggagcccccctgaggctgactgggtgggtcacagggagctcatcatatgtgtcattacaaacaggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtacctgagtgagtggtggtagcgggtggggtgccagccccactggtgggcatctgccccacaccaggattctgcacacgttcctatcctagcatcttgtgggccatggggacaatgatctcctctagaacctcaatcagatgctatttattaacctggtggaggtctttgaaattccacaggacc

SEQ ID NO: 1029 - DNA, 137 bp, Homo sapiens
ggtcctgtggaattccaaagacctccaccaggttaataaatagcatctgattgaggttctagaggagaccgttgcccccgtggcccacaagatgcccaccacacccggctgcgttatggctttaaaaataatgtcat

SEQ ID NO: 1030 - DNA, 190 bp, Homo sapiens
tatcaggattttaatctaggcagtctcactcaccatggtgtggaaaataaaaagcataagcattatggccaaaacccagtgttattaatacctgtaacagtattgatcagtattgataacctggttcttggctttaatttcatttttctgtttgcccttgttctgttgtcagggaaattaatctagactc

SEQ ID NO: 1031 - DNA, 289 bp, Homo sapiens
aaagtgcccatttagtcaccactgccatcgtcatcaacaactgagaaatcagccttataggatggcagagatgttttagtgacatataccccatgttggccactccacatggtcgactagttgttcagactggagagctgtctctgcctcctggcactaaatggggacagagtggattctgccttctggccctttgactaagaggagcccagcgagagtgcagagcattttaacttgaaatctgtgctgagataggctgacaacccggggagggggtgggggtagaaac

SEQ ID NO: 1032 - DNA, 409 bp, Homo sapiens
gtggcaaatcctgcatgatgaaaaaacttccacacaggctaacagctcccttcttgagaaagttgagtctaaaccaaaggcctttctttaaagaggccactgatattatgttcgtcacccacacacatagccccttctccactctgggattgccacgcagtctcccccgagtggtgcccagtgtgcaggctgggctgggcctggcttctgctctgtggttagcctgccaccccctgggccttggaaggccagttagcccaatacctgctgcagcctcatttctgacattcctgcatttgtgtgatcactaatgctgtgataacacaggttagcatctgatcggatctgctcaacattagcacttacataaccaagtcatgtgcgtttagttttattaataattgaatgc

SEQ ID NO: 1033 - DNA, 54 bp, Homo sapiens
ttgaatgctcagttggaaatatgggtgtttcatataagattgggctagctatca

SEQ ID NO: 1034 - DNA, 707 bp, Homo sapiens
aaaaaaaaatgggttagctatcttttaggaagaatattctttttgaagcaaaaaaacagtgtagcagccaatgatgcaaagaagttattggtcctgcatgacatggcttttaaaacttcatgttataaaaatactgtgattattgatttttttaaaagtaaaatgacaaattaatttttctatcccaataatccttttcattatggtgaattttgctttagccaaagatcagcttttactgctattttccaaagtgtgcttgtggagtatttctctgcattgcccacatgtggaagccgtattctcaaactttcttcatggtgtactcagatccccgcactgatggttcccacagctaatcaatgatctgttcactccaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgtgtgagtaccaggcccccaccccctccctgaggatgggggagttgaaagactggattctaccttgagctttaactcctggaactaagaggccaccaacattgcccgtccactccttaaaca

SEQ ID NO: 1035 - DNA, 29 bp, Homo sapiens
cactccttaaactcctaattctaggagca

SEQ ID NO: 1036 - DNA, 89 bp, Homo sapiens
cagactcggccctgccatcaggtcatctggaggggcccgcacagtggttctgaaagggtggtttccaacagcattagcatcaccaggaa

SEQ ID NO: 1037 - DNA, 124 bp, Homo sapiens
tcttggctctaaagatagaacctatcacagttgttttttccacattttgacttggtcttaatatagacaacacacatcgtcagtcagagatcaatcatatgaatacaacaagaacatgctcttt

SEQ ID NO: 1038 - DNA, 431 bp, Homo sapiens
acttgccaggccagtccaagtggaggtgtcagtaggcagctagacctgggttcagagaagtccatttggcgtcttgccttcccccagactcgggagaggagaggttactgtctagcccacatgtgcatgcatcttcagaacccgtggactcccaaggaaggttgggtctgttttgtctggccaaggacagacagcagttccatcagcaggcaaaaaagtaatgatcctgagcagtggtgtatgctcttaaatcgaactgccatagagagatggctagagggtcccctcttaatacagggttaactgtgtgtaggcatgagagagaaggcagccaggatccccagttggccagttccccccatgtccaaatagcctgccagcctttcagaccacatcactgaagccaggcccttttaaaattccaacactgg

SEQ ID NO: 1039 - DNA, 228 bp, Homo sapiens
ttccaacactgcattccacgtaagtttagattactgtaccctatgaaagttgcattatcttgttcttgaagtctgtggctaattaggggacatctggtgactaaaagagagtctcattgaaagacaacatctgctgggaggttcccatcccgacatcccgacgaaaggttttcttaaggatcagtaccaccaatctggttagactgacagcattatgggtgaggagaa

SEQ ID NO: 1040 - DNA, 911 bp, Homo sapiens
gaccaaatcttgccagccttgataaagagttgaagttttcctaggtgcaagtaaagccattgtagcatgttaagctctggctactgagtgaggacatctgcagttagaggggctctgagggcctgggggtcttggcccactgtgtggttacagagggagcactcacactccccaacccttgcagtcctcctgctggtgctgcttttgttggtgagaaagaagcggaagatcaaggagcccctcctactcccagaagatgacacccgtgacaacgtcttctactatggcgaagaggggggtggcgaagaggaccaggtggggcactgggggctctgggattgggaggtggatgcccctaaggccactggcagggctgttgggtcaaccaactgaccaagttagctgtgttgaccaggccctggcatgaagcatgcgtcttccttttctaacatcctccagcacttctctggtccattgctgtagtctctttggccctagccaagttaacctcaagcctatgtttaatttgctaggacaagggaggatggaaacgagggttttccaaaatctgtgacatcatctgtcttgtaagacctccccatgagccagagtatccaaagggtagggggtgtggggtgagatgtaagtggcaggggagtgggggacaggagtcctcagtcacctgctctcctgcatttccccacaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggtgaggcgtggcaggccagtcgagggccaccctttattcaagcccagcaccagccaca

SEQ ID NO: 1041 - DNA, 102 bp, Homo sapiens
tatttgagtaacttctggggtttgtttcttcctccatagaactcacttgcagagtggttaaaaatgattaggaggggctgggcacggtgcctcacgcctgta

SEQ ID NO: 1042 - DNA, 406 bp, Homo sapiens
tgggtgcaacttatggctgtagtgaatgccgagaatgaagtactcagacaattctagctgagcggggcggggagcagttcctttgagagagcgtcactctaagatctgtctgccaggtatttattgagagagcttgtttaaactacaatttagacaaacaagagacatccaccaggtggctcttggcggtcgggtatgaggcacatatggccttgtaaaaaacactcaaaccacatttttaggaggctgtgttcagcgctccttatcacacatactactccctgtcctgttttcaaggtccaggagatctagtcttgtgtacaaacaacatgcacacagcgcctcaatatttttccatgcctcgacctcacatgcctcttacataggcttgaatgtcttgtcgtgc

SEQ ID NO: 1043 - DNA, 45 bp, Homo sapiens
ttaggaatgatttattcatttattcaacacatatagcagttgaat

SEQ ID NO: 1044 - DNA, 100 bp, Homo sapiens
tatagatcccaggtgattgcacctggggggcaaagtttggagcctctgctgtagaagacttcaaggattgaacgagcaggcagctaggacagtgccagca

SEQ ID NO: 1045 - DNA, 137 bp, Homo sapiens
taagtttcggaactactgacctagcatgtagcgcttattagataatgatagctattgttgcgaggtgctattctaataactgctttacaggtatttactcatttactcattcatctgttcctttaaaactatacgga

SEQ ID NO: 1046 - DNA, 1055 bp, Homo sapiens
cactgagcacttgctgtctgctggtccctgagtgaatgaattctgcatgaataacgcattctttcatttctacctccaaaacctttaggggaggggagagaggggctcacagagaggaaatggaggcttgcagctggcaagaggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactg

SEQ ID NO: 1047 - DNA, 298 bp, Homo sapiens
aaagagtgggctctgtttaccctgctggcttcacccaagcttcctctcaatggcaggggatactcagggtcagcttccatgcctaagtgggctcagggaggggagacttgccctcctttgcaaagtcagttgctccatgagagagaaccattaacctcttaccccaaggctgagcccctccacagccccagcaaggtctcttctggaacagcggctgccctccctgcaggacagtgtgtgacgacttcctcttctatgctggaggggtccctgttgaaaggcaggggttggggaacag

SEQ ID NO: 1048 - DNA, 147 bp, Homo sapiens
tacaaaatggggagtttttgtggagattaagtgaattaatatctggcacatggtccatgcaatctgttagttggtaacagctaccatttattcagtacttttaaaggccagacaggacttcgattatttcctctaaatcctcacaat

SEQ ID NO: 1049 - DNA, 1872 bp, Homo sapiens
tgtaattcttcatgtagatatacttctgatgttctgtcagaatctggtggtaaagaactcagattttctaatttaggtttcaggcttttatagttatttgtactgccactgtcactattttggttcatattttttgtcatttgcaaatcaaactcttggtcttctttcatttcaaccgtaaccacttctgggttccttgctttcttagtgcttgcatcattatgaaagttgttatctgtactaaaaatatgtccaatgcctagtttgttatcattgtcgcagtctaatttattttcatgtaaatgaagcttagaagatgactggcaaacatgttcctgggacccagagtacggatgatagtatggatggatgatatttttgagactgggttctttttgttcaggaaatgtctcgaataccactgagacagatatttcagatgcatcttcttcctcacaaccaggtatgttatttgtcaaattaaagggaatatccttcacatctgttcctcttgtagagttatcaagtagtggctcttcctcaggacaagccggaattttgtatttttcataaatttcaccaaacctctgctttaactcatttatgacgagttttaattggtttttccactctaatttgccttgttcaatccacatttcctcagatttttgcacatgaggaagtactggatatataggtatatcctctctatcacaatccttagccatttctggttcttgagacgttttctgcaggtgcaaaagtggaagattaatttgcttgttttgtttcttgcgtgtcttctctgttgggctacatgttttaaaaatagctttgtccttaaataacaggtatgaacaaagaaaaattcacaaataattaaaatgaaaatttaactgttaaacttcttcatctaggtttagctactcccaaatcactggcttgtaactaagaagttaaaaacaattgtcttacctgaaaggaggagaaaaatatgaaccagcaaacttaactttgtcactgtttgtttggaataaacttaattcattatgtgttaattctaccaaaaatgaattagcagatgatttctagtgttacaaaggcttcctcacttggaaagtgagcccctacagtacatgtaagtactacatattactacatgtaagtactacatattactacatgtaagtactatatattactacatgtaagttctatagattactaactggagggtaggcaatcttcaaattattaggagcccgaatcaacaccaatcagaaagaaaagcaaattcttaagttttaattcaaattatatactgtaacatcatagggttatatatctagactatcttcttcagttcagttctaatatatactacggtcccctaataacactaactaaaactttaaagataattcttactaagtttctgcatctaaaaagttagaaatttattgtttgtaccctaacaccaaagatcccattctgcaaggtacgattcccttaataggcagttgggttgatttcataaccccactctcactgaatgtagaccgtgaagtcaatgaaaggccacatctttaacctaggcattagtaactggcaatataaaactgcaaaatttgagccactggccatgattactcttagaccatgaatccaactcagtggccatcactgttaaattgttcataatttctgttgcttaataatataagtcaataattgacattaccttctttatcctgtaaggatattgtaagaatggaagagcaaacaaaattctggaatgtttgcctctactccaagggtaaagattaactataagttatgatagattctaacaatattgtgttttataactag

SEQ ID NO: 1050 - DNA, 695 bp, Homo sapiens
gtaaggatctattgattctcaaaggctagtctgagaggtaatttcatttgggctagcttatattattaaagcaaagaaaaaagtattaaaccagacatttagattttagtttaaatgtttccacacctgtggctgcttattttcgcatcctttaagtctttcttgctcttcctctgatgtcagctccaagtcttgttctgctgcaaaatccaaacgttcagttaaactacttagaacagttagataaaagacatagtctttataaaaatagattttaaattacatttcattttatttcataaattgagagtttaaatgaagcttgatctttagtggaatacttacttctttaagaaatacttctaattctccaaaacttcaacaaaccactttctgggagacactagatgccaccaggtaaaagaaatacaatcatgttgaagattcactcacagattcatccacccaacatcaatgaacaaagccatcacaaacaaaacaaaactttggaatgcagtagcaatattatcaggcaatgctgcatactgttctccacttcataatagtaccttattaatgatttccaaaatgactgtggacacctttattggtgtacaacctcttcctaacatctgaaatggttccctgtattattctgacaaatgtattaatattttcatcttttaaaagactgc

SEQ ID NO: 1051 - DNA, 56 bp, Homo sapiens
cagactgctaggtgaagttgaccctcatcctcatctttccccagggtaaacaggta

SEQ ID NO: 1052 - DNA, 555 bp, Homo sapiens
aagcaagcatgtcagagatgacttttctagagatcctgcccgagctgaggcttaaagagtgaggctagcctaattagaaggggtaggggacaggaaagagtgagagcatgacaggcagcaacaaaaggcagaaagaggcctgaaagagtatatgagtttgcctgcaatcgaaggatgggtcagcaggacaggaccagcagttcagtaaggccagagaaagggcacacaggggaaagggctaaagatggagagctgagcagaatcacattatgaaagccttacgtataactttaagatgcttggacattaatgttctcaagagtggtccctggtcttatttgcattggtgatagaacactgtcaatgccaaaaccaacatccctagcaaacacatttattaacgcaaggtggtagctcatgtggacacagccaaggagatactatgcagcaaattctcaataagtctcattaattactgacttggaaagtcaattctataatacataaagtcatagaaatgataggaagtcacttaatatttgcttttggaaggtg

SEQ ID NO: 1053 - DNA, 1080 bp, Homo sapiens
gtgctgagattacaggtgtgggaaggtgtcttttaaattatagtgcatatagttataactaacagctgtgaattcagagctgtaaaaataaagcaaagaaaccacattgtgtttgagtcagcaatctttaggtctctactaagttatcctaaatataatcctatgttagtccctaaacatacttagtccctatattctaaatataatcctacttcctaaagaaaatcatgctttcccctaattctctgttatctagatgttgctttggttaaaggaagaacacaaatatcctgccaaaaggtattctgttcagtgcaaaaggtgagtaaacacaaagcacattttaccagaaaaagttttaagtcaaaactatagctctatgcagccaagcagaggcactctaggactgaattctctatgcttctttgttaccttctttgctctctttgttttctggtagctgtgattggcacaggtcatggagagtatcattccctgagagaagtacaactccagtgtccattttttctcgttctgttaagttcatctgtcccagttctttggttgctgactgattttcaggcattgatggtgatacagatggacttttatcaccaactttcagattcttggatctctgacaagtctcatcactaagggtcaaattagtaggatgccaatctgaaaaatccgaaaatgaagttttcatttttaggatgtaaataacacaataatttgactaacttgtatacatgctttcttcacagaaacagtcccacatcctgctctctcccacaacacactatgcattcaggcttattatattttacatgtcctatgcttacaattcattcaggtaagtttaattaactatcatctctcacttttctacatttttactgtttactattacttacttttattcactcagcagtctctattacatattttgctttccattaagattctttgtggatataaattttttaaaacataatttatgtctaaccattttaagcttaaatatacatgacagcattgtatgtatgtattgtagagacacaggatttacaaaaactc

SEQ ID NO: 1054 - DNA, 240 bp, Homo sapiens
gagatggtcttttctcaattcaccactatcttcagaatttcctttcaaatacttggataaacttcatacatttatttgcaaaataagagctgtaagggctctaactgttcccatgtgagaacaggattagtctaggaccacactagatccaaatagcacacagtgccacgagacaggaaaggaatacataacaaaaatattttcctttttactatataaacaaaattgttgggatttaaa

SEQ ID NO: 1055 - DNA, 126 bp, Homo sapiens
tgagatttaaattttttaagacaagtgaaagaaaaaagccaaaaacacataagtgaaactttaaagtccatttcttcataaagggtgcatttatccacaaccacatatgtggtttaaaatgttgac

SEQ ID NO: 1056 - DNA, 44 bp, Homo sapiens
gtcatagttctaaaggctttggaatgtatggctgagcgtgcttg

SEQ ID NO: 1057 - DNA, 62 bp, Homo sapiens
ctttattttaattatttatttatcattatgaagagagtttgagatccagtcatttgatagaa

SEQ ID NO: 1058 - DNA, 53 bp, Homo sapiens
caataatatttaatcatataaaacgaaccccaggccaaaaagtttcagaatca

SEQ ID NO: 1059 - DNA, 137 bp, Homo sapiens
actgtgtccaccatgtagttattaagggtaattaattgctttcttcgtttttgataatcaaaacacacacacatgatttgctgaccagaatatctgactggcttaaaatcatcagtatagccacactatgatgaaat

SEQ ID NO: 1060 - DNA, 233 bp, Homo sapiens
caactaacatattggcaagtaaagtttgtcttatctgataagttttggtgctgcacgttcaccttatattctttccacctttctaataccccactcttcttttgaagtattatctcattttaccaccctccatcatatccacttgcttcttttcccttcatttactctctgtactctctgccttccacattctttattcccccttttactcttatcctcttccttctatcctg

SEQ ID NO: 1061 - DNA, 983 bp, Homo sapiens
tacattttattgtgtaggtctatgggtgctgtgctgtgttctgtggcaaaacatagggaagagaccagggataaggatctttgcaaagacttttcagctgccagtggagaagagctcaagggagatcaatgtactcactctcactaatcctcttctggggcagatgctggcaatgtttactgagttctagctattttccctagcacaaacaaggctcaaattcacctcccattttacctcctatggacagaaccactggaaagatcactcccttaaagagcttattcactctgagccacaccattcattcagtgagaagcttaagaagaaacactgccacagtggtggcaggttgccagggagtactacctggtatgaaaaatatatataaacagaactatcagctcactcaagctgccagaatgtgccaacagttgttactctctctggtgaaaacaacattatttttcatttattgtaaagaaaaacactggcatttcctatgacagagcatttagttgtagatgagccatattctaataatatagactgttttcaagctcatccctaaaaggaagagaaccagagaggaacatatttattcacctgtagtgttcactgcctgatcttctttttaagtgcaaggtaagtatgcaagactttgtgattccagttttataaagtccagctcttgagattatcccgtcccatcgctagactctatctggacccatctcctagagcacgatggtccagttagtgctgtggaatactgcatgatgccatttttccccaccctccccgttacgtggcaaacatctacagaaatcacgctttctcagcacgtcaaatcatacgccatcagatcctgttctgatgaacacaacatgaggaaaacaaacacaaggacaaagaacatctaaaatgacagaatcaaattaccatggaactttattgtttaaatattcaaaaagatatccacc

SEQ ID NO: 1062 - DNA, 586 bp, Homo sapiens
tattattaattctaaagcacatactcactgaacttgctattaccctaaattataaaaagacagagtcaccttgaaaattgcaaatcactaaagatcaaggtaacagaatacgagtactatctccgaaattgaagcatataaaaacacataaagcaattaattttaattgtatacttaggcaaaaaaaaattcacaaaaatgattgaatatctgatcttatttcataattgtaaacagggatttagtacaatatgaatcaaaactggtccatccatgaaaataaaatgaaagacaatttttattctaattttaaatcagaacttattatgcctactttatcccacaattttactgaaaggttaatcagataagaaggacagattataattacttaatattgccatagtaacttatgtaccaatacctgttaagtattcaccaaatgtcaaaactgtaagcagccttgctatttaatatgaatgatgcagctgaaaccagtaccatgttatggtctatcatattatttgctattgtattatataaaatgttaagataacaccaaaaatttactcaggggcatagctgc

SEQ ID NO: 1063 - DNA, 363 bp, Homo sapiens
attgcattaaacaattttttattgtttaagttgatgtgttacatgtgactacaatcagaaggtaatttcacagaatacctttccctaatctgcttattttttattttttgacatttgccttggagattcctgtacttctatatccactggactaaaggcattaaaaatgcatgaaacaatgatgtcagaaagtaatttttaaaagcaacaatcctattttaactcaattaaaaatagaaaatcttaatgactgacaatatattctacagtataaaagtttctggaacaaaaaattataagatcacagtcaattttctcccactaggtaggatttaattcatttttataataattgtgcagcag

SEQ ID NO: 1064 - DNA, 141 bp, Homo sapiens
gtccaaaaaagccctgcaaatagtggaactgatcagtaaggatcaacaggacttttaacttatctggccgggagaagagacatcttatgtatagatggttaaaagtgtggtaatccaattgaccacatattctagttaaat

SEQ ID NO: 1065 - DNA, 736 bp, Homo sapiens
ataaagaagtgcatttgaaatgtgttctaatagtattttctttaggaatggaattcaaaaggaagcagtaagagcagaaatatcacaagagggtaaatgaaaagggaactgcactaacaaaaggagtcaggcactgacttttctcctgatgtgaccaaaaccccaagtactgagaactgctatattcagcatttcactttatatttttctccaggacattatattagtttcctgcaataaaatatttttaaaatgtcagtttgtctaaactgctggcctgtaaactatttctaatcaaaacctgaaattgtgtcacaacatggctgtattatgattccatgtcagaggaacgatatatacgtgcatctggtggtggcttccagttgttgctgtcagatgtttgtttgggaatgcattcagaagagcctatcaaggacttgagtaccaaacaagcatttccacaaaaaagcaggtaagaaagactacacttttcctcacatatgaccttaggtttagacaattctaggaaaatggtggtacattaactcaccagtcttgaccattttccctgatcctgtacagggagctgctgcagttacaaaagttaggtaggatcttggtaggtgtattcttccccatttgaacatcagaagtactgatcacataaacagcgaaccccacaactctatgattgttctttagaagacagtgccactgaaggcttttaaaaggttaa

SEQ ID NO: 1066 - DNA, 210 bp, Homo sapiens
cttttctgcatctgctttatatttccactgtgacacatttattttatgtttatatttcctagttaaacatgggctcttaagaattggcttttatagggaaaaaacaactattaatgttatttcttaaatgaaaaaaaaagtttaagtaaaataaatgaaaaaggcatcatgccaagaaaaagaccgacatttttaaatgagtaactgagc

SEQ ID NO: 1067 - DNA, 76 bp, Homo sapiens
tagctctgataaatgcaaatgtttcttttgtttccctgtctctttatgtggttatcttccagctgctctccatatg

SEQ ID NO: 1068 - DNA, 162 bp, Homo sapiens
ctttataccataaccagattgccctaatactcaaatctaatcatgtgactccccactccaatgagtccctacagtaaacattgctgtctccctacccaatagcgattccctgtttctcaatagagaaacacgcatctatttggatatttatcatgccaatag

SEQ ID NO: 1069 - DNA, 151 bp, Homo sapiens
cacccttctgagtcttctccctaactaaaagaaacatgtaaagatattgtcggtgagaccacgatgtttggagctgttgctaattagtcagccatgaaaacagacatgaacaaaacaccatgttatcactgaaccatcaaaacaactctgg

SEQ ID NO: 1070 - DNA, 43 bp, Homo sapiens
aatttcccatggcctacaggaaaagttctactcatttctttct

SEQ ID NO: 1071 - DNA, 36 bp, Homo sapiens
cgagatctactcatttctatagtattaaaaagtctg

SEQ ID NO: 1072 - DNA, 406 bp, Homo sapiens
gtctgtcatgagcttgccttaggtattcacttcattcccaaccattcacatctcatatgttttgcactggcaaaactgaactgctcataaaccctgcaaagttcactcaagcatcttacttttgcactcgctgctccttctgccacacacacaatcttctgcccacatcatccttctgcctctttacctagaaaagttctactcactcttcatgcttaccttaaatcttacccacttttttacagctttcattcctcaccacataaagtgtctggcacatatttaacataataaatgatcactatacggttccagagggcatctaacacagtagtaggcactgaataaataattcatcaaataattaaagtgacaatgataataacaagctcctgggttttgttgg

SEQ ID NO: 1073 - DNA, 796 bp, Homo sapiens
tgggctcctcatggggtcttgttctgctgtgttgagataccttcttgccttccattgtatgtctaccacgttcacatccatcactgcaagtaacataagacataggttatttacaacaggaaactacctaaatgatacatcatgatacattaacctagtatatgttaagatgacatgggaaattaaacagagatgacagagttcaagctttgctttccaaagagaacaagtatgaatcataaatataaggattataaaaagatacatttaattgtttgttaggacattcagtcccaaatatttatccaataccatatgtgaggccccaactcatgcatcttgatgtgtcttggtatttccatgactctaaattagattcttttttctgtttcctagatttcacatttctatatctttccacatctcttccctgacccctatttcccctgtttcttcctggcttcctcacctggttaactttttttttttttcctggccttgactacttttctcaccatcagctctagctctgccatggtgttagttctcattaggatttaactagaagtcggtgcctacataactcctcaaaatggattgaacaatagatatctgtgaaatgaacaaaataacttatcttttcccatgtactttcttggtagggatgaatttagtcatgacagagataaagcaaaacacatctacaaaggctaagcctgaatgatcatacttactgttcagaaacctctagtgactctatgtcagaacttggatggtctgtgatagaaaagtcagt

SEQ ID NO: 1074 - DNA, 783 bp, Homo sapiens
atcctagggaataatctgaaaggagtgggatgagttgctcatatcaagtattacatagtttaaagttgtaggtttgaaagtcagtttcagcccatgagtagtagcttccaaaaaagaaaacatcctcttatgaagtttaggcagcggatgatactcactgaggaaaccatgattaagtctcaggaaacagaaatgcaagataagacacaatctgcttaatgaatccggatgggtgggcctgatattaaaggcttctgatgtcacgaccaaccttaatcataaactacacttttgaataacatccttctacttctccatctttatccacttaaaaaattttaccttgatgtcctctttctcacacaaactcttggaccttgtgatattttatcagtctgtagaagaatccattcctcagatttcccaaaactgggtgaaagatgtcctcgtggagtcaaaagagacttacatgattccgaatgggattctagtctcaaatggcaaatttctaccaaccatattttaaaagggcatggatgaaaataattcagtaagcctataaatagaaaataaaattaagaaaataagtcaaattgttgcatacttccaaaaccagcctcccttcccagcgagaaaccagatttgcttggtgtcataaactgcttcctgctcttcagggagctgccatttccttggctgtatctacccgcaagtgtcaattcctgataactttgctagagtgtgataatacaaagcagggctctttgagaattatttttaggg

SEQ ID NO: 1075 - DNA, 128 bp, Homo sapiens
tctaggtattttttgaacaaggatgaaaaagaattaacagggtagatgattggggtgggaggggaatcttgagttagctgtgagtgaccactcttccttatttcttcatatgcctagagaaggagatc

SEQ ID NO: 1076 - DNA, 699 bp, Homo sapiens
actcctcttgtcatctatttctttctccctcgtgatcaaaagataagcttgtcagacaaactgaagaaaagaagagaagatttatttctgtctttgcctctgcttttgccgtctttcctcttgcctcagaagtcccaagactccatgattttcatagggactcctgtaaataaagaaagctgagaaaataaattcccactatttgcagtttcatagaaggatgcctagaagaggcagtactagctctttcagagggataaacctaagtcattatttcttgccagaaccagactcctgtttcccacttctgcagaagacattgtttcattgttccatcaggcagctaggtgtaaaatccggggctcattgttgatttctttctcttttcaacttcaaattaaatcactggtcaagatctgtggatactgtatccaatgtcattctcttctcccattccttccaccaaacagtctaatttctcacttacactattgtgatagtcacctaactcctttctctcttttctcaaattcagcctccataacattggatttaccatcaaggaccagctttgatcatgtcacctccttgcctttcaataagcttcattggctccccactttaaatatattctgatgttctttcagctctgccctaaaacatccttaacattttatctacaacgtttaggtttttaaa

SEQ ID NO: 1077 - DNA, 82 bp, Homo sapiens
ggccaactttttatttatcccaagttcctgcctgatatgacatatagtgagacgacatacttttcctggtattttccccaag

SEQ ID NO: 1078 - DNA, 414 bp, Homo sapiens
tatggaatcatggggattggaagcacatgtgtgggtcagtgagtgggggatgtgtgttttttgtttggagccaggtgggctatagggatgtgtattttttgtcaggagtgctttagaggtcattttttttgggcttggggtcagccacatttgatatgtttccattgtaaaatgagacagagaagcctaggcccatgaagatgagagtgctgtctttggctgtaaccctgatttatgagaggagctgacaaataactagtgctgaataacgttgcttaacatttccccctggagttggccaaaagagtagtggagagagagacaattcctgtttattgagtgtctagaatgtgcagtgcaggcgttgattttgcttggttcttttgttttgcttttgtgtgtgtgttgggggag

SEQ ID NO: 1079 - DNA, 221 bp, Homo sapiens
agccacctggaatgtcagctgagtttctatccagtgctacaggagcacacatgagattctatttttttccccagtgcagtctgtaacaaatcattatcttcttttaagaagagtcatgaagactggaagaattatcccaggctgaggccttgcaaacaactctctagtgctaggtcaaaagcttcatccaagtgaaacctttgtgccctcttcttttatgc

SEQ ID NO: 1080 - DNA, 304 bp, Homo sapiens
agagttgatcacagttggtgagataaggatgttccttttctcaggtttttatgcacattctcagaggactttagaaagtcaattcaattcatttatgaaactgggaaatgctctataacttctgccccattatgtggttatcttttgataatgcatcccagatgagattacatgcctaagtgtagtacttctgtgcagtctgaatctctacaggcagtacagccaatggctgtatcatctatgtgcacaactgtccattactcaccatataattcatgaaatgacctctttcattcatttagta

SEQ ID NO: 1081 - DNA, 142 bp, Homo sapiens
aaaagcctggaggcaaagaaaatgaacctaattctaaactgtctttgacagtaagagctaaaatagaataactatccagttcagtatctgttcctaggtctactttgaccaagaaatgtgttttatttttttgcttttaata

SEQ ID NO: 1082 - DNA, 107 bp, Homo sapiens
tctatcaagcaatgtgtctttgagagccagatgggacaacaaataatgattgcggtggaacacagcattttaaaggtatacttatgttgctgttttggagatgctat

SEQ ID NO: 1083 - DNA, 549 bp, Homo sapiens
ctatgaatggagcaagtgccagtagggacacatttaaagataggcacacatctgaaatttcagctggctaaagattaaaaatctggattaaaaattaatttatgataaaatggagggctaagaaaaatctatcaagtatgaagtatgtggctggtttctgtggttgattttttagttaactcccaaagggcaatcctctccctgaaatgaactactctagcccacccttactcccaactggaggcgaattgctcttctctctttggaaccttgaaaggatttagccctataaggctggagttgctgggaagatactcatagatatatttgaaatctctcgtgtcacaggctttgaagatggcttgctggtggacaaaggtaaacagatatttgagtgagttttcccaaggtaagcctgctcactgtattgcctttttacccatctcagctccagctttttaaccaatatgttctaggatgtcagaaaatttgaaaatttgccagtagatttgagaacatttgaagttataagagaagataattctttaa

SEQ ID NO: 1084 - DNA, 582 bp, Homo sapiens
ctcttagcactttttgagaacatgtcacctaaatggaaagaactctgaaactggcaataggttaaaaaagggtacatgggtgaaaggctatgctgtgagatggagcgcctggtgttttttactttatgcactggtaatgttcactgggattaaggagatgattttgtgtgcctggttgtggtatgacgtttggagagaatcccttagctccattgttaaatgtgagcttgcctttaaaaatgaaattttggggatctttcttttggaacccctgatttctctttctttatccaaattccgctcacacaaaaagaaagagtcatggaaattcttccatggtaggaaagcaaggtcacatgatatatagttctggagatttaggttaaaaaaatgagaactgacccttaatggcatggaagatgcccttaacaggttgtgctgtctccagggaaatcggctgtgtggtcttgtgagagatcaccactgggagcttgggcttgggtgctcgccgtcagcagcaaagaccccctttctcctgtggttctcaccgtttcctctggaggcccctgtagctttggtcac

SEQ ID NO: 1085 - DNA, 71 bp, Homo sapiens
actggcactgttattgggagcctcctgctattctcagtctcactttttcatccttgggcttatccaatatc

SEQ ID NO: 1086 - DNA, 40 bp, Homo sapiens
tatatccagtatctttatcgtaaggtgtggtgaaaatata

SEQ ID NO: 1087 - DNA, 280 bp, Homo sapiens
gaaatctccaaggtccttcccaaccacgacatttcaaagtttatgatttgttccaggatttccaggattcggcataacgtacctgtcgtcatcccttccaggaaccgtggcttttcttgcctggcccaggggttgagaatggtggtggttcatggccttcagtgctctttggtctcaccgactcttgttccttttcagtttatgtggatccgtgaaatggaaattctccattccatgtccctgccttcattccttctagcctttgcattgttgtaggcgc

SEQ ID NO: 1088 - DNA, 118 bp, Homo sapiens
gagtgctgaggttcatggtctgcttgggtgctgtgggagcttatgaggttcaggccatcctaccccaaaatatggcaccttggcacttgaggaaacagaatcaggccatagactctag

SEQ ID NO: 1089 - DNA, 703 bp, Homo sapiens
ttgcagagcactttagtatgggagtcgggggcaggggtgaagggaggctgtccaaagataaagttgaagctgtgatggatgactaggagttcctcagacaagtgtggtgataggaaggggtgtcactgagcaggtgcagagagggcattccaagtggaaaacacacaagtgcaaagcttcaatagggagagagaagaaactagaaattacttagagtggtaaggcacaaagtgggacaaaaagggaaatcagagggtgttactttagggcccccaagaaagcctgtcctcagggcaatgggaagccagcagtggctggaacagcagccaaagattggctttctcacacctgctcctgacgacctgactatgtccctatggctgtgactcttgtgagctgtgctctcaggctgtagattttcaggagagaggtggatgctgctaggggaatgtgattagcaagcagtggagatggtaagtttgactgtctcagcaacattctgaggcctgtttttcctcctaggtggcagtcacaggaattatttaaatcaatgtcatttcagggttgaggcccccagcacatcgtaatggaaagtgcactggctggggttaagaggcctgattgctcattgaggtggcaccatttacgaccttgaatgacactgctgggggttcagaacacaataccccaaaatatgacactg

SEQ ID NO: 1090 - DNA, 144 bp, Homo sapiens
gactctggcaagtagcaacctttttcagtttacttactctcagtgcccttcccgctttagaataaggtccattgattgagtaagatgccttcccaccttgtccagtgacttgtgtacctggcggtggttctgggcgtgtgctct

SEQ ID NO: 1091 - DNA, 1769 bp, Homo sapiens
taaatatagggtacactttaataaaaatttgccgcagcaaacgggaaaataccaatttagctctgtttgctgcagcttcgcagctttaccaggagagggcgccgacggacctgacttttgccttgcctcgcagtagagcccaactagagggtaaacagcagccacagtaagttctagctgttgcagaaataaattacaaatacatgtaggaaaaaggacttcaaaaggctgcggtatcaaagtggcagttaaagagaaggcaacgctcagagttgcaggtggagcagcggcggctgcatcagcgtctcaaattgcgaaaacattttgggctgaagtatttctttgtagcatttcgtggagcccctttcctttgatatacactagccttccgacttccctttgttcttttttcacacgtcaggttttatcgctgacaagctccaacgcgtcaaaggcgttagatctgagggctgcagcagccttcgcggttccgcattgagctccttcctgcagccctctgcggaggtcacggccacgtgtgggcagggaaggccccctacccacttcctcattcggacccgtcacctttagccggcgaccaccttttgatctcttgtgttgcacttgtgtcccccgtttctcctccagcttccctggagtccctcattgtggagctgttcacggccccagtccctgcacagcggggttttgcacgaaagaggccgtgagggccagaacttagtacagccttgaatactggggcggggaatgggggtaagaaaaacaaaacctccccactggtcctcttctctctctctagcactgcatattcatcttgacaccaagtcacacccccatcaggaagtctggttttgggggtagtgggcacaggacgatttgggggatttttgcatttgtttgagctacagggaaagagaaatatttaactcctgaaaagaatcagcataccaggtgccttattatactgtgtgtatgtgctattgagcagtctagaaacctttctgcagtcgtgttctgcagatttcatcccaacagaaaattgcatcttccaaaaaatgtagttcaaaataataaggcttcattcatttttaaatgaccagagcatttccttctctcaggggaggggggcagggaaggggattgtgtggagatctgtactaggaaacaaatgcctataggtgtaggagagacatgttttataattttaagaatatacaagggacatctgttctcagtttacactgggatgctcatatatttattctaaacaagaaattcaaatggaaaaggcttcactgtgcaggagagacaggaaaaggaagagtgaaatcgttgagagcacgggttttggttttgtggtgacagattcaaggcaatgaacacacatgatgttttgctcctcagggccaggttgtctccagtgtgtagtgtatacacatttaaatgatggtttgtaactgcagagttgttatcttgactttagaataataagaaagaaaatagagaaaatgcaagggatactccacagctgttcttgatttgtcactgtgatacaatctagtttttttgttgttgtatagtttatttgttttatggtttttgccctccctcacaatggtctaaaattctgaagcttctctgtcagtttctggataacagggaaccatgtcttcctaccctcattttgttttcatttccacaaattgaaggtaaaggtatttcccttccacttcatgccaagaagtcaa

SEQ ID NO: 1092 - DNA, 466 bp, Homo sapiens
caatcccaaggcttgtgctctttccactgtgccaacttccttttgcatcttgatccttctcacatggcaacaccttttcaacaccttttctgggtagggaccttccccctcactaaccacccagaggttagactcctcttgggagtcagaagattgtgctgcttgctcaagatccagatggcttgcactgtgcagctcacagtagatctctgtcatgccttccagctgtcaaaatcccagtgggatactctggctggtccacttccagcttctttccctgtctgaccccctttataggctatatgcctgggatctccttgctcatgtcaaagtggggaagacgtggcttctgtggacttgatggtcctactgagaaaagccagatgaaacttcgcttgaaagactagggataagaaagcctacttggcatgacagcatccaaaatccatttgttggtcacaagttc

SEQ ID NO: 1093 - DNA, 95 bp, Homo sapiens
ctgctccacctgcaactctgagtattgccttctctttaactgccactttgataccgcagccttttgaagtcctttttcctatatgtatttgtaat

SEQ ID NO: 1094 - DNA, 489 bp, Homo sapiens
agattcttgggctcggtcatttgaatgtttccagtggtttcacccagattccttttagcatctatttaagtcattgtgtttctagtgtcccatgccctgtggtgaaaacttctgggttcggggggttgggttggcttagggctaggactgggccagaaattcagggacacgctacttggctgcttcctccagcagcctgggcaaggcccctgagcctcctcctgaaccaatttttcagcctgacctgaaattcttgtccagaacattaggacagtgggatctttaagctgggagctttgatgttacttcatggagttcgcctgtgatggtttccctttcactttgtagtaactctaagagtaggttctaggaactaggttcttgcccgattctttgtgtctaagctctgcttatactgctgttctggtaactgagtcctagtcttgttacctacagggcctgagctcctgaaccctttccctgtacagg

SEQ ID NO: 1095 - DNA, 316 bp, Homo sapiens
atcaccttctctcgccttccttgtgcccagttatcctgggaccagagtcttgctcctaaatgctggacgctgtgctgggtgtctatttctgggttcttctgatacaattacttggctctctgaggcagtgctccagctgcccgtctaccctgttggatgcaactggacttcatgatgtcagtactcccagggacttcttcctagtactgacttcacccaaacaggtctgcgtgccttcaggtcccagctgtcctagtttggctcatcacttcagtctcaccccttctgactttcacacaccttcagagagacttcc

SEQ ID NO: 1096 - DNA, 151 bp, Homo sapiens
ttgcttagagacactttctttagaaaagattcagaacaccaatttgtccctagcaccattcagtttaaaacccttcaaaggttcctcattccctttcaaagaaagttcaaattccaagttataatcatcctttaccagattgtagtatgat

SEQ ID NO: 1097 - DNA, 255 bp, Homo sapiens
atgtttctcaatctgggtccttggacaatagccaaacagcagcagcaagcctctcctatctgcttgcacacaggtggcacaaattgctattgtttctatgacaactgatggcttttttcccccatttcataaaagccgcctgtatggtggacagcagcatgtggaagaaatgtgctaggcagggactagcctggtagaacgcccaagcaacgtataccgcgattttattgtcttcaccagtcgtggctctttgtc

SEQ ID NO: 1098 - DNA, 753 bp, Homo sapiens
tgttagctgttatcatttttcaagattgaatctctagctgtccacttttaccacatgttccacctagagtgaaccaccagtattccccttgaacatatcatggtttatgtttatacctgtttatgtgttatttcaacaacttgtctttcaaaacccagcaggatttcggcttaagagaagtcttcttttgcttcctatatgatttagatgattctaccatactacacaagcaacatctactatcacgccatcttttaacctgtaattgacctattctttcacctgcaatacaggagtcatcttcagaggaagggatgcttctcagtgtttgagtctacagcacctagaacagtgtttgcggagagtgaatactcattcagcgaaaggattccattgcttgtaaagttatgattatgaccttggtttcctcagctattaaaggagccaagcttgaccctcctttagcatgacccagagtggttcaagccaggagctgctctgacactgactcagtccctgggtggtgatgactcactgctggggctttaccttccagagcctcttctgatagatgggattttctgaaacttctttcctcccattggatccatgattccagcactgtcctccacagctcagggagagggtgctttgttctgtggactgtgcaaagaccttcttgctgtagaatgtgtgactatgactgagctattctcagaggctcatcagaagtgctagaagaaataccttgat

SEQ ID NO: 1099 - DNA, 1930 bp, Homo sapiens
gtcagggctctttttaacttattttaatattttatttcttaccaaacacctagaattcaagaagatagggctctttttgactctctgtctcatgcggctaagccaaatccgactgatctggtgtgcaatttgttctcgtcccagcaggagcatgcgaaaagcttctgaatgaatttggaccatggctcagaatcgagcctcaaaccaacccacttgcctggtgtgaggttgtgttgttttgtagcctctggaaactttgccctgcgaatggctgcccccctgcctcctactgtttccatgtgattcccaacctcactccctcaggtctctagtttcttctacccttcatttggatttgactttctgcctggtgacagaccggccgcccagctcgtgtcacccatggctttaacaccaaaccgctaagtctccactcccggctcactgatctgtatgtacaaaccttggatactctcagcttccttcagtactgacaaagcataaagagcaggagagagactcccagaaggtctgctaacatatctcttctccatgagtcaaacagacctgaatttttacatgaggttaatatagttaaggccactctgtcccatctctcaggcagatgcgttcagtattgggtgagccaccagggattgccagccatttagagcctactgtggaaggatggggttactgatttatggggaaaccattctgcaacagacgcaaagaggccatcagttaagagaaagccatggccacccggccttgggctctatcagcgtgatccttggccgttcagcctcacccttgggaactgttcctttcccaatgctagccttcatcaccaatttaattatgatttcttagagatgattatagcttctcctgatgagaacagatcccatcaggctgaggtccacacctctgttgttgttacacctgctatatattctaacaattctaacagcagagtcacccctgctgttccccgtaggatgacgctggtgtaaaaaggttaccgttgcttcagtggcccttggagaggggaattgggggttgagtctttctcaaagcattcccacatcgaggcttgtattttaattaaccctcaatcctaagcaaatatgtgatagcccacttgaagggtgcagatttgcttgcttggcagaaattcaggggctcccttttaagccggttgatgtttctcaatctgggtccttggacaatagccaaacagcagcagcaagcctctcctatctgcttgcacaaaggtggcacaaattgctactgtttctatgacaactgatggcttttttcccccacttcttaaaagccacctgtatgatggacagcagcatgtggaagaaatgtgcgaggcagtgactagcctggtagactgcccgagcaatgtataccgcgattttattgtcttcaccagtcgtggctctttgtctccgagttctttccattgtttgccatgcaagtcacatagaaggaggaataatagctgttaggctgaaggaagagagaccccagcaatttgtatgcaatctcatttgaactcttggatttgggaaggcagttttgcttccccccctttttttttttttttctaaactgctgctcagcttcttgtgcttaatgaggcttttcagaagggaaaactagcaaacaacaaaacatgagttctgccctttaagcaattgctttctaaattctttatcagaatatagttgtactatcaaggtgagtaaagaatttctatatttgtaatttacagtgccttacgtcaaacaagtcagattgcgtggctcctgtaacagcagtggcatttaacatcccatttcaatgaatgagggatctataggaaaaattaactttctgaagataataattacctaattaagttaaatatttctggttg

SEQ ID NO: 1100 - DNA, 311 bp, Homo sapiens
ggcaaaatatcttggaaattgtactctgtagtttccccagatgggtaaagaagtttcaagaacattttgggagctagggtatcagaagtctaaggaggtgtttagagattgcgtaagctgtctgcgcagcaagtatagagatcacactatagacagagagatttaggtaaaaaacaagtcctgggttcaagatcagatggccagaagggggcagtgtggggaacagtcttgcatctagttattgaccctagcaggtgatgtagaggtttgcgtgagacagagagaacccagaaataagggggcttgactta

SEQ ID NO: 1101 - DNA, 71 bp, Homo sapiens
gaggctttgtatcatatagcaagcagctttaaactacctaggctgattgcttttgggggcttcgagagcag

SEQ ID NO: 1102 - DNA, 1105 bp, Homo sapiens
gcagaaataatagcaaagttacacaagttacatggcacctgcacttggttggaaaacttgtggcttgggaactttcttgggaacttcattccgtaatagtgtgttatgggtcttctcagaaaaagacttcatctcctcaattcacccctttttatttttaagtatattagcagtagcaaacattgcgtgagggctcagaactggagaaacttcttagttccaagatttcagagcagactctgcaaaggatggggcaaagatgctctgaaggatcccaaattattaagtgacctttgtatgcctatctgtaaaatgggactcaagccagtgaccccgtttttaagttagtggtggtaatattgtataacttaaaaagcattttgcccaataaatgatagtgttcaagcctaagagtcttaagcttgttttgtgaaaccagctcagtctaaatgatatggcgaataagatagtggaaaaaataaattatagcttttgaaggcttcttttttattgaaaaatagtcatattaatattaaacttatgttctccatgacgttcataaaatttgatataaaatattgccagctcatctgatgaatggctaaacccttcaatttacccaatcttcccctataattaacatcctattttgccattttctttatctgggaaacatttgcaatgagtgctatataaccactgcctccaagttaagtttaatttagttttatcaatgtttatgcatagataattattcttaagtgtgtaaatgcaaaaatatagatttcttgttggtgcaacctttttttctttttgtcttggtttctcgcttccccacaatcactcccatgtcaacacctttgcatgtattctttcttgtatatttatcacacacaaatattcaattctatctatgtcaacacttgtacactgactagggttttggagtatctcactcctttacctgtcgtttatagacaggttccttccttaccacctttttgctatgtacgttctttagtgacatacagttaccaaatccaatgactattttgtagtgaccccttttctaggctagtgttgataacatcatataacttttttt

SEQ ID NO: 1103 - DNA, 138 bp, Homo sapiens
ataactttaaagcattttgcctaataaatgataacattcaaatctaagagtcttaagtctgttttgtgaaaccagcccaatctaatgatatggcaaataagatagaagaaaaaaataaaataaactttcaatggcctc

SEQ ID NO: 1104 - DNA, 37 bp, Homo sapiens
gtcatagtgatattaaacttatgtcttcatgtgattc

SEQ ID NO: 1105 - DNA, 87 bp, Homo sapiens
gctagttcatctgtgacctcttgtgataaggaaagcaactcctgttattaacagaactgtgcatcatatattctaaaaggcaaaaac

SEQ ID NO: 1106 - DNA, 421 bp, Homo sapiens
ataaaaggcaaaaacttaataaagagatatttaatgtttctctcccatgattaaatattgtaatcccattagagatcctatgttgaacaaataccatgatccctctcaaatggtactggatccctgtcaagtagtccctcctgaggttccactggcttgtgactacgagttccatcttcatctctaccacctgtcatgaggtttcatactttctccccgacttctgatccaaaggcagctcctggagggggtcttacgttgtattcatgtgtttaaaaataaccctctgctttcgttgtgtgaatgactggggtgtggtgaccccagaaacttattggtgagccctagccttcttccttcctgcatgcaattcagtccttgtagaaagcaaagtcttgtttttattttttattatcattat

SEQ ID NO: 1107 - DNA, 83 bp, Homo sapiens
cgtgagccacagaacccggcaagtcttgtttttattatgtaagatctgtgtatgcctctcatcccaccccagcacttaaccac

SEQ ID NO: 1108 - DNA, 494 bp, Homo sapiens
actaccttcttaaacctctcctcacttgcctctcaggaacttttacttgattggcaccctccctacctctgccccagggatgctatcgttcatttatcctcttctctacacacatttgggagcccaacagctcctaggacattaaccattatcttttgcagcaactcccaaatatctctgtctagccttgctctatcttacctataacatgaacaatcaggtggatatttcaatttagctgctccgctgttgccttctctttgacatgaaactgtcaattaattaattaatgctcccacttctttatttaccttttatcaattctgtgtttaaaatgatcattcctggcactaggtgcaaattattagaattatctttctcacttaatctcatatctatatctgatctattgcagttttagttaagataatgctaattgatatagaaaataagtaaaaactattatcatggataatagctcatgatagcagcac

SEQ ID NO: 1109 - DNA, 193 bp, Homo sapiens
gttgccaaatcacgcagattgttcttctgtagtctttcccatccatgtcctttgcccatttccatggctactgtgctagtgcaagcccttattgtgttgtatgtggaataccacaatgtttgctgaatgatttgtcttctaagttgttttcctatgtctagtcttttctcctgtaatgaattttgatccaaca

SEQ ID NO: 1110 - DNA, 127 bp, Homo sapiens
tctgtattcttatttctcttgattcaacttcctgggcccttttgtatcgtcaaactgatctatttaaagtatctggtcttcaggttcttcctcactcagtttcttccacctaactttaaacggtgac

SEQ ID NO: 1111 - DNA, 1123 bp, Homo sapiens
tctatgcctgttctcttttgaaaaaaaaaaatcaaggtataaaacctacctgtccatgtttagaagtataaataagtttgtataaataatgccctgagttgattggtattcacataatagttattaaatgagcaatttgcagttactaagaatgtccttctccattggtaaccactcaactcccacactttagtcaatattttgcctaagcatcttcaaaattttgaaaccttcccagtccgttctatcccaaatgatctcttactattgtgaatcattgaatctacttatttggcaattaatcttgtaacggtttatgatatttttatgtgcacaggacttttaatgttatcttctgttggaaatacccttcctgtgaagttcccctgcttgccagtgagatttggagaactgactgtggcttatgtgtgctttaatcttcagtgccttgcatagtgatgttttttggtaagcatatcaataagagctctttaatttagtaataataaatacatttctagtgttcattgttgcagtcctggccatggagtgaatcggcatgtaaatgtttatttggtagattttaaggtaccagttagaaggtttttgctactccaaattatgagaatccaagctcataattatgaagaaattgatggaactgtgaatactgagcttgctggcatcctggccccccactggggccatttgaacacttcacattagtaatcacttccttgcagggtagtgtgggccccccatgagcagttaattaggggaagcaggtttattactgcaaagtggttgagtttagaacaagctaaataagaagattgaaatcatattggaagaaacatgggatattaatacattggctgtaagtaatgaaagataaggatagcattaaattctagcaacaatatattaactgcaagggaactaatttgtaaatgagtgctttgcctctctctgagatggattttcatctgatgaaaggaccacgagaacggccaccacggtgacacctttggtaagatttgagtgtagttcttagtagctgcgttttctggggctcattgcaatgtttggacttggattctttagcagcaaaagataataccct

SEQ ID NO: 1112 - DNA, 1324 bp, Homo sapiens
ccctggagaggggcaaagagaagtttttttttgttttgttttaaaaaaacttcatattcctttaatagacatgaaaaaaagtcactgatgccttctgatagtgtgtttttatgacatgcctaggagtggatgccaaacacaatggggtttcctggcctccttaggtggatgggtatggggcagagggagtaatagtggtgggagttttccagggttttgcttgccctttctgtaacaaggtggtattcagagtgggacagatacttaggagaggagcttggagggaggtagatgaggaaccaaaatcttttcccttggccctaatttgctcctgaaatcatcccactgtcaaggcaggaagaaggaaatacggagccaaaagggctagtggagagaggggaaaaaaaatcaccattgttccatgtggctgggctttgacaatactttataataaagatttgaaggctgctctctggagactatccaaagaacaagcagtgttttgtggaaccatgtcgaatgttaaggggacatttgagctttctttaacatttacctttctttcttttctgattgacctcaaatttgagttacattaatattatttaacgtagtccagatctttgctctccttgctaaatatcctacaacatttcctttaattttatggaaagagacctagagacatgaaggtagattagtgatttactagatctacaaattagtagcaaaaccaagactagaatacaaaactggggatgagcaattatttgctttaactattatatgttctttgttaccagtgaagagcttattgtgttgctaagatacagtctggtcaccattgaagggcattgttctatgtacaatgaagacactgggcttgattcattgccttggggtcttaatcatattatttatttcttcagttcacaaaattttataattcaccatgggtgttttagttaattagtacaaattggaaaggtcttatagagtacataattatttcctacaggaccctctttggtgattataaatccagtttcagtgaatcttgacaaggataaaagcaattacttcaagttcgtagaaaacctcacagttctcatgtttttcagtattgtccagtaaattctgcattataattttaatgtcaaattatatcttttgaattatacacacctcaacatgtatggataaacttagaaactttagtagagtccttctccaaagacttattcactaaatctctagacctcttctttgcatcttaaatacccaggcaacaagaattggtagagacacttacgaaactgtagaa

SEQ ID NO: 1113 - DNA, 86 bp, Homo sapiens
aggggtttcgcccggggacctttggctaactcctgtcgctgtcgaaaccaatattgcattttttttcttgcatagaaattctaatg

SEQ ID NO: 1114 - DNA, 229 bp, Homo sapiens
ttagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactc

SEQ ID NO: 1115 - DNA, 1834 bp, Homo sapiens
actctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatag

SEQ ID NO: 1116 - DNA, 1840 bp, Homo sapiens
aagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctca

SEQ ID NO: 1117 - DNA, 111 bp, Homo sapiens
agaagttcctgtctttccttggctgctataatcttagaggaaacattttgccgctttgctcctcattgtgaaatgagaaacaggaatagtaccagatcaaaacccattatg

SEQ ID NO: 1118 - DNA, 1282 bp, Homo sapiens
ccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtat

SEQ ID NO: 1119 - DNA, 337 bp, Homo sapiens
ttcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtg

SEQ ID NO: 1120 - DNA, 825 bp, Homo sapiens
gagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgtta

SEQ ID NO: 1121 - DNA, 785 bp, Homo sapiens
cacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttg

SEQ ID NO: 1122 - DNA, 71 bp, Homo sapiens
aacagaatagagattccagaagactccaaaatatagcagattgatctttgacaaggggacaagggcaatac

SEQ ID NO: 1123 - DNA, 64 bp, Homo sapiens
tttattttatttattgatctaaagattcaatgcaataccaattttaatttagagacagagtctc

SEQ ID NO: 1124 - DNA, 49 bp, Homo sapiens
gttggagggcatgatcatggctcactgaagcattccttgggcgtgatca

SEQ ID NO: 1125 - DNA, 410 bp, Homo sapiens
tagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctc

SEQ ID NO: 1126 - DNA, 1438 bp, Homo sapiens
aacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgc

SEQ ID NO: 1127 - DNA, 159 bp, Homo sapiens
aggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttc

SEQ ID NO: 1128 - DNA, 444 bp, Homo sapiens
ttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagac

SEQ ID NO: 1129 - DNA, 142 bp, Homo sapiens
ccttgctctgagccattaggcttggtggtaactaagaagatctcactaagatgcgcattccctccttcttgctcaatctccaagatttcgaggacaaaatggaaattaaaagtaaggcctacaagatggctattattttaaa

SEQ ID NO: 1130 - DNA, 716 bp, Homo sapiens
aggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacag

SEQ ID NO: 1131 - DNA, 215 bp, Homo sapiens
gatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacact

SEQ ID NO: 1132 - DNA, 36 bp, Homo sapiens
cctctatttatcagacagatgtatagaaagtttatt

SEQ ID NO: 1133 - DNA, 68 bp, Homo sapiens
cagaggataataataatcttgagtctactgataacattattgattgagcaattattaaatctaggcac

SEQ ID NO: 1134 - DNA, 209 bp, Homo sapiens
agaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagc

SEQ ID NO: 1135 - DNA, 334 bp, Homo sapiens
atggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttc

SEQ ID NO: 1136 - DNA, 210 bp, Homo sapiens
tcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaac

SEQ ID NO: 1137 - DNA, 290 bp, Homo sapiens
ggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgca

SEQ ID NO: 1138 - DNA, 507 bp, Homo sapiens
tctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacatt

SEQ ID NO: 1139 - DNA, 339 bp, Homo sapiens
taatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattct

SEQ ID NO: 1140 - DNA, 130 bp, Homo sapiens
agaaaagaaaaaagtagtctatttcagtttgccattgttagctgtgtctggatatggttgacgattaattagtaatcaatcagaatgatcttcctcattgtcattttcctctgcattatttttgaaagca

SEQ ID NO: 1141 - DNA, 69 bp, Homo sapiens
ctaggtttgacacctcaataaacctgaaatgtgtacatcctatggtgccaccatgaaaatcaagacatg

SEQ ID NO: 1142 - DNA, 90 bp, Homo sapiens
taccttaagagctgatctagaggtaaaatgtctgcaacattcagcaatgaatttagattttctttgaaaaaaagttcattttcaaggtag

SEQ ID NO: 1143 - DNA, 1200 bp, Homo sapiens
ccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaa

SEQ ID NO: 1144 - DNA, 528 bp, Homo sapiens
cagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggt

SEQ ID NO: 1145 - DNA, 267 bp, Homo sapiens
gattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgc

SEQ ID NO: 1146 - DNA, 471 bp, Homo sapiens
gataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttc

SEQ ID NO: 1147 - DNA, 91 bp, Homo sapiens
cattttgatggccactttattttgacaaagacactagtggaggaaagtctctttatcggatcatcaatttccctataaatctttgtctcag

SEQ ID NO: 1148 - DNA, 115 bp, Homo sapiens
gtttcacatcttacattattcacttttgatttagttggcttgtgctgtcaatatgttgcccactgtataacactacctgatgaattacattcaactatgtagtaatacatattac

SEQ ID NO: 1149 - DNA, 1007 bp, Homo sapiens
accatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacata

SEQ ID NO: 1150 - DNA, 271 bp, Homo sapiens
acactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcag

SEQ ID NO: 1151 - DNA, 411 bp, Homo sapiens
tgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttacta

SEQ ID NO: 1152 - DNA, 97 bp, Homo sapiens
gtataatcagaagccactggagagttttaggcttgtctgtggaaatgaaatgatataagctgtatggtcaaaagaaaatattgactgttgaacagag

SEQ ID NO: 1153 - DNA, 1400 bp, Homo sapiens
ttaatgaggctaggcttctactttgagtccatagatcttacaaagtgacaggttgtccaaataacgtgcagtgaaatcaatgaatgaaaaaagcaaggagcatatgtgattactggacatattagtgctttactaaatgaacttcatgacttccctttgaggtaaacttttggatattccatttggaaggttatttacaaatcattatcaaacatgtttttacaggaagataagagaaggtaatttcatttaaaacagacaaattaaaaagacttatactactttgtgggtagggagttgtatttttcacctgaaatgacagaaaaaaatatttttacaggaaacttatttaattgaagctattgttaggcactgcaaatgtgtttggttcatgcgacagttcccaggaatttatacatgggttcagattgttgttcaggcaccagaaaataaacctccaagctatttactgcctccatgatatataaagtttgcagctttgattttgtgtgattatgttcagcaatggtgacctttagaggcaacaatattgaagtgtaatgaggagatgtttgatcactggtatacaatgaagagttggtgctacttccccatttcttcctggaatttgtgaaattcaactgacaggctttaacctttagactgctgaagttataaaatgtatagggatttaggctgtttatacaacacgttagatatatgaaatttttagacagtgtagcttcctttatcatctagtaaaatgattttgtatatttaataataacagtcactggtaaccatgacaagctgcactcgggtatatcatgaagtatatgaagtgtaggttgatgaaaataggagtgggggccatcatgtaaaataaatagacagcgggcattctccccagaccaggcgttttcaaaatagatggataatgctcctctacttctgtttcctttccatccagcgtagcagagaagctagtaagagatgacttatgggccctgcttgctaaaaatgtccttgaactcaagaatgttttaaataaaggaaaggttaagagtgaggtgctaatggattagaggctgtgattaccagcctcttttagaggtataattgttgatgggaatgttggtgagggagaaggaaaccaatgagaacagaagttcaggatctgtggccccactgttgtctgagtgattcgtagtagtgtaagatcccccaaataaattattcctagttcttttttataaatgattttactaaattgctgatttcttggcttggctggaagcaataaggactaattgataaagcatacagcttttcctaattaactataggattttgattctctaggtaagaatttatagagtacagtcctctatcggtatctg

SEQ ID NO: 1154 - DNA, 1402 bp, Homo sapiens
ggggggcggcaactgtgtagaacagtgtgtctcatttccaaataagcttatgattacaagcatatgtattagtgataggaatttaatctgtagggggaaataatttaccttaggtattagtttaaaaacatatatataaaagaaatagagaattaaatacagaacctatttgtgggcactcatgtaaataaatttccaccaaaatggaatgttcatgcctcttgcctagttgataataccatggcaataaaatacatttattaaatgccaagttacatttggagattccagagatgagtcaacaagcgtggtcactggcttctatgaccttgttctttttaagacaagttctaatcttatttctttccgtacccctagttttttgttttgttttttttttacacagaatctggaagatagacaccaagtaaatttataccgaatgaataaaggaatgattgaagattaagcttaccaaagaaaaattaaatgtcttaacaaataacatgattaaagaattgatgttttgtattccatatagaaaaaaggggacaatgtgaataatgtagcatatttcctaaagaaaatcaagttcattgaatgtttacaaaagctggagccaagtagattgaaacgtagttcagttgggtcagcaaatgtttgcaaacatttggaattcaagggtgcgaaattcaaagcgtagttagaagaaagacgtggtgatatgtaaacttaaggtgttttctttgagcattttgcatatctttgtattcaagtccttttaaacggcataggtttttggagtcccatataaagtaaaagaattcatctgcccaatcttgagctgtttttccatatatttccaatattagtatcagacaacagtaatcgctgatatttagaatgtaactgtttctgagagtagtcattcctatcttctcctgagagacctgagaatcaactggtgagaaagagcctcaaaaattgtcttgcacagtttccccatgattctaggcagaatatattccacccatcaggaaaatggctggttatcttatggtgatgaatatcttatagtcttacctacactacaaaatcatgtgaggctttccttctctgtctctggttatacacccactgtgtattactgtctgtgaggacattacaaactgtgctgtgaggacaggaccaatcaggctctctatacgtgcttaagcagttagggttgaaggggtagtgagtgagtagagctccccttgactttctttggatagagaagttctacttgataagattgcatgtgacaaaagacctctggtgctaaaataaaagttggaacctatgagtacataacgaaatacccattttgttcagtttggaggctaagaggtatatgcagaag

SEQ ID NO: 1155 - DNA, 139 bp, Homo sapiens
tgcagaggtatttttttacagactactttccatagcctagttttctttcaactggaattcctattaaatttcaagtactactttaaatatgaaatattttgaaagttcagaggatatagcaacagcaaggtgaggatgg

SEQ ID NO: 1156 - DNA, 121 bp, Homo sapiens
gtctactttgaattagacatgtggaaagaaagggtgttaatatcagtgaatgctttttaacgtgcatttcatttatgaaagttccaggaaaccagaaggacagttgtgcaaaagcaaccag

SEQ ID NO: 1157 - DNA, 480 bp, Homo sapiens
tgaagattagaagaagacatttactaaaaatgagttatagttttaaatgaccacaagttacgaagtcttagttacttaagtaattacataaaagagatgaggaaatattgaaatggcattgaataatagtgagaacaggagcagatctaagagttgtgtggtatgactacattatgaagcctgactcaaggtgtgataggattagaattcaccgaagtaagggcaggcaaaagggattctgaaacctactccatgactctccaacatgatgcaagtgttacattcagtgtctttagaacttcaatttctgagccttttatactattactagaaattattttaaaaattcagattttttcttatctaaatgagataaaacctaaaattgttgagttacattgtaaccattttagagcccagggtggttaattttatttataattatggttggtgaaataatcttattcttttattatttta

SEQ ID NO: 1158 - DNA, 31 bp, Homo sapiens
actaacaaggcatttattaataaataatgta

SEQ ID NO: 1159 - DNA, 421 bp, Homo sapiens
ccataactctccttgcttttcacaatagagttatttttcaagttaattatgtcttggtctattgcgtaagaatgaccatttacacactacttttttcctctgactcacatggaggctgcttctaacttccatccaacccttcccttgagagagcatctccactgcccaggcactgggccccacctgctgactgctggggagactatgaccatgtgatcttctcaaccagtcccagctccttgtatctttctctgcatggagcactaggagacctggagcctgaaggacactcttttcacctattttcttttatctttcacttcttgcagttttgatatttttacttcagataatggttctgttatgtactcaacactgtaactcattttctcctttgctgtgctcttgttgtctacttggc

SEQ ID NO: 1160 - DNA, 1881 bp, Homo sapiens
agctgttgtgttttttaagaaaaaaatatttcccatgttcattttacctgtgaattgtaaaacaagcaaaacaaatcaaaacagaataaaactctgctactaatcatgatggacaaaggaatgggctttactaaggataagcctgcttcaaggaaaaataaaaccttagatttaaataaaaatcttaaaatgagaatgactcaggattccacttcatagactcagtggcatttccggtagttttcaagttaccagcaaaggttgctattattggagatgccaactcagcaagcacaaaggtaggatccaaggtcctgagattttgggaccatgagcaagtcatataaatggtggtagtttcacttgtttgtctattaaatgagaaggttgaactaaatgactgaaggtccctctgggtttaaaacctaatgttattcagtgaagtagacctcacaccaggctttcttgctgcatgctttctctcctctaccatgttcatttttgtaagggaaaattttggaggtaaatgttatagttgccccaggaagccctggcttcaaaggctgggagtggggcaaatgaagagggaatgaagctgaaaacctcaacactttctcccaatccccgcagaacatcttggccttgctgcccttcatttgccttttgaaacagtctcctttcttttctcctgtgaaactaaacatcttggttctgtttgagcattctctctcctttctcaagggctcatcttccttcccttgcccctgaaaagaggaaattccccagagctctatccttaggtttatgttttctctctgcatactcgtgcactaaacttggtgcattcacatcctcaagtgagagcactaatgtgagattttaactagtgggctgatgttaatctctgcccattgactcccctcccagtcaccaaacccttaaacccaaacagccttcctaaagctcagccctcttccccttcatgtctttacatccagccaggtagcaaattctgtcattttaactctgaaatgccatttaaatctcttgctccttatcctaactcttattaagtcaaaggaacctcataagtactgtgcaaaatctttctgaataacgggtgaccatcaggagaatctcctcaaaactgccatgatcacatgagtccccttctcatgagctgtcagtgttctctgacccctgctcctaagtacagctttacacatggctttgaaggctaaccacaacctgactccaaactagctttttagaggcccatcttgcacttctctctcactccacccaaccacttctttacccagcaacacagactctgtgccatgcctcagacaagcctactcttttcctaccaggggtcatttatgctattccctgcactcagaacaaccttcacttgttcatcaaaattcagctcaaatcacattttcttcttagatatgcttcaactactcaatttccaaatattctctcatcttttgaattttctatagctcttaacattttttcccaatcaagagagtaattttatatccagtgcagaatatctagaaattagagaaaatcagtggaaacaccatgaacttttaaaaagaaaatactgctgacatttggatatgtatgtagtttcagtattttcctatgtgtatttttatgcaaaagtaatataatatgtattctaatttttaatcagctctaattacttttatatatatttggaacttctttcttataaaagatgttctttaacaatatgatatttaggaacccattagcctttaaaaattctcttacagtcaacatttacaacattctactttggactctgatttggtggttccaggtctattttcggtacttaag

SEQ ID NO: 1161 - DNA, 1233 bp, Homo sapiens
ttagaaaccatacaacaaggtatcccaaatactacctggactgtctcagtcccagagagagaatatacaggagtgttcacccttgtgatcaacaaataaacataaccatcctttaaaaaatcaaagtctttagaaaagttaccagcatggatctgcctaccaggtgccttgctcctctctctagcataaatattttggccaccatattatcctaagtcttcctcctataactttccaagttcagaatttttatagcattaacatgacatggcagaaagccaggatataaacagaatctcctgacaaaaatgaaaacaaaattataattagttggataaggattttctttcatatttagacatattagcttcttttaaaccattagagttgcacaatagttatataataactaggacaaaaactgaaacttcattcactttatgttttggtttaagccaatttaaaactatattgcttaatttctgctttaaaaaaccagtatattagaggaaaaagcttacctatgtgtatgaaggctaagttaaatattgcaatgtgctccctaatattgctgatttccaccactggtaagggctacttcgtgtttatcagctgagattttacatttttgtggtatactattttaaggcaggaaaaaagttcttttcgttgtgacagttacttctctcctttaactgagataccttgttcaactgaagtgatcttaaatgaggtgggctttattatgagaactttaaattcgtgtcacataaaatttaatgaagtatgaaattttaagcattttatattttcatatttttaaaacagtgaaagacttacctactcagcttactttttgaaagaaaataccaaatcttccatatttgatgggtattattttaccaaatttcaagtcacacaactcctcgaaatattaaaacatctttacgtttagttagcaaaaatgtaattggtacatttttgaggagctcggcctttaatggatagatttttctcaaattccccaaattatcttcaaactccgaggcatttaagaaaagagaagcaaaacagcattagaagaactgcgtggaaatcaagatacatctatttcaaagtactccagtagaatatttgacattgtcatttcctagagccgtccagttgacactatttttcaccaaattaggaaaaaagatttaagatgcatttgtttgtcgttgtgatttatct

SEQ ID NO: 1162 - DNA, 295 bp, Homo sapiens
agatgttacttgtgccattaaaaggaaacagctgtagtctagtttggactgcctacatagagagaaaacaatgggcttaggtgttttgaaggaaaagttctgattccattattattttcattccacctcaagcaaattctcaaaaatgatataaaaagagaccaatattacttgtctaaaatttttctacctttacagatttgttggacctctggataagctttatactttttttctgtttttcttcacatttcatggtatttggtatcaaatttagcaaataaaaatgacaaat

SEQ ID NO: 1163 - DNA, 756 bp, Homo sapiens
gttcgaaagttagtactatttgatacttctggggtcactgttttccttcaacctttcaggagtcaagatctgccattccttcttgaagttattggaaatgtagactatcacctcatttatcttttgcatcattattgcttctttgttcatcttgtatttgtcttcttttgcttcaagaaagagcccaactttttcttgatctggtagccatctgatatcaaagtttgttcagtcacatcatcccccagctatttcaatcatgaaatcctgttcgtttggaaaaaaggtgacagaatatattaaaaatagacctaaagataaatctatttagtgctcttaatagttagctaattagagaaagtaatcctcaggcatttgaaatagggtaatagttttcctaggatattaatttgtagaaattgagatccttcttttatatatatcaacaaaagatgtaaacatatttctttacatagattaaatgcttttggatttatatagtgtatttgattaagaagggaaatctaaccatgacatagtagttatcttatgtaaattcttctaaatcattttcagggcttaaaaaaatctaagcaaagatggtacttcatgggtaagttgtctctcatcagaaaagtaagtgaaaggtctaaaagaaagaatacttattttttctccatttagagagaagatgtattaattatgactttcacaggccaattattgtatccttggtctttttagttgatctccatt

SEQ ID NO: 1164 - DNA, 63 bp, Homo sapiens
ttcacctgctataactgttctttattattttattgacaaatgtttaaatgaaactacaacaga

SEQ ID NO: 1165 - DNA, 2747 bp, Homo sapiens
tgaaaacactaaattattattctatgttcggggattattgccaaacctaatgctatcattcatatataacatttctaacactagagtggtgagacttacttttggcttctaatagtatctctgtaaaaaccaagaaaaaacaacaacaacaacactgatttcttctctttcactttttccagacccaagatattaccttattctgcaaacaaggactttaagcacaaagaaggaaatcatagtagaagtttcaactgtcaacttctgcttaggatatccttaataaaaccttcatgtcgagatttgtgaaacaactgacgaaatcactggcctgaagttgcaaacaaagtattaatcaaggcagccccactgtggcttaataatatcaatgacagacacttcttggcaatcaaggatcctctgatgatcatctaatcaaacagcactgattctatcacactatggctttggttgagcttaacagagaagaggattcatccataaccaaacaggttcaacagaaccttgaaaatcaaaggaaagtgcaaaagaaagtggttctaactttgaattgtggcatcaaggaacagtaaataaaataaattgaataacaacttctgcagagctgagaagtctcaaagtttccttcatctaagaatatgttaaaatgacattgatggggtccagcatattggagcctgaaatctgacttcttcacgtgaaggtgtgggtattaatttggttaatttctaatgatcatccataataacttacaaaagagtttgaataatgaaacaatgtaaaaagaaatttggttccaaaaataagcctttctaagacagaaaatgtcttaaaaacctgcagtatttagaggcttaattagtatactgggtgattatgacatctagctcgtttcattaccttcctaatgtattattagttggcagttaaatactgtctgctgggacctaagagtttttcctcttgtctttctggtcatacttattgcctaggccgacagcttacctgtagtgaggaagaaatggaacaccaattagaaagctttcagcccagcacccatggaaaagccaaaagctgataaaggtcagcgtgaaatttgaatgacagggctaaagtcttttactcataattttgtgtttgcaatagaattcagagcaattcacagccttaaaggccttaagtgagaacagcaattaattgtaatgaataatctgacaaatctggttgacatatggctgctaatgccctcctttctagtgggagcagtggagggattagattaactcaaatgaaatctgggaccgccatgccatctgcatgttcagtaggaaacggtacacgttaaatggtgagtgggtagatatctgtcttgtactcatctctctctgagcccttggcagatctgggaatagcagttttattactgcaccagctgcctgtcaatagagtaatacaggaacggcatgaagtgcaacctagaaagctaatataccaggaagctgttaaaaattaactagatacaattaacatggacttctaaatttctctgtttatacaatgcatatttatattttgattttgggtttgcctcattgaatgttcggtaattaaacaatgtcatttccatctgccctatttatatgttctacctgaagatacaagtggcaggtagagattgaatttcatatattctcatgagttaataaaactttcacttttccattattttgagggtcaggtagagaattattaaatgaaatctacaaataatccctgaactcatttagaaagccccacctccttccctcaaatgcaccccttccttttttttttttttttaactccaaagttaacaagtggtgaattgcagtgaattactctttcccctctttggccccagcactgcccctgatgaaggaggtaatactcagagatgtggccaaaagcaagggggcgctcattgtgattgatttctgcaaaatcaaatgttattcgtttctgctgggagaggaagactaccattcacactcatttcctcctaccagatttaatgtgttccatcataaagccaaattcctccttgatctggctgctctgctgagtggagtttactttttattttacttgagtaccttgtattacattctaaggctaagctgttatttgaacaaacaaccagtacagaccttgcctttgggatgtgagttaaatccctgcccaacttgctcacttccacttaggccccggttgccactgccagttattagtcgctggagaatatagatcctgaaacctcattctgcctctttctctttataggcttttcacttgatcaagttaaatccgtacaaaccttgtgtgcttgaaaagaaaacaaacggaaattctcttcccaagtcttttgtcagtttcttagagatttccatggaacacagtagtgtttgatacaggttatctatttctccttcctatcagagctgccaatcattcctgttttaaaggggagcaaaactgaacacaagcccattaactagctcacttttaatctcccagcaaatcaggagagcattcagatgtgtatacagtagccttttccaaaatgagcaaatctgatttgatcaaggataaaacaaaaactcatcttcctgcaggcaagtatgcagaaaagtcaaaacactaagagagacaaagttcactctctggaaacatcagcctggatggtcagg

SEQ ID NO: 1166 - DNA, 972 bp, Homo sapiens
gatggtcaggttttaatacatcttccttagtgccttagtggttgagtttgaaggcagtagtgggatgacagtggaaaaaccactcctccattttaggaaaaggtaatctttacccaatggtgtgtggtctcagacaagacacttaatctctttgagctttagtttcctcttctgtaaagtgaattggttcaactgtgtgatattggtgtaggggtagatattttctattcctcctcagtatgaactgagtggtgttgggttgcctacagctaacatggggttgccatttctcctttcgctaagggatccaattaccatctctaattcattttaatgttttgtaaattttaaatgtattcaaagtactatacctagtaatgtcatatattaaatatcagcctgggatcttaataacttatttgtggttattaaaacctaaacttgggttgtaaagttatctccaacctctaagcagtcttttcatctgcctccaagccagatatttcttaagcaaaccagagagaagaaatgctgcttcacagcctattaaagatggaagatttttacagcctttgttggtaacaccctccaatgtttttaaaagcatccttaatatgaatttttaatttcctaaatgtaaaatgagcccctcattttttttttgccagtgtgaataataaagaggctgctatccataatggctgaattgtactatatgtttttttttcaaatattactgtggatatgcatactgtccttaacagttaagatttagaataccatatgaaatcttctactcagtgatcattttgagactttttaaaaagcagttgttattagttgctaattatgcgtgttacgattggaagttcaatatttaggtgaaacctaaaatctttataattttcttctcagcaggaataattttgatatgaaatttgaaatgtatggacacttcatgaatagtcttct

SEQ ID NO: 1167 - DNA, 98 bp, Homo sapiens
atgatgttttatgtaaagattgcagatgttcaaactagtgattacatctatggtttccatcagtactcagattttgggacctttgaacttgagcagaa

SEQ ID NO: 1168 - DNA, 855 bp, Homo sapiens
ttccggatgacaattctttgattgcctgctttaatctagaacagctctcatgaacagagcattcttgtgtattagaaaaagagggaacaacaacaacaaaaaaggagaccaactagtaagtaaataaaaaatgaaggaaaggatgagggtacaagggaaagaaaactcatccctccctcatgctacaaacaactgccttaaagggccactcactgtcagggaagccacaaatcgcccactcctattttagaattcacctgtctagaaggtaagcaaatagttttgtaaagttattttggggtttatgttttatatatttttttcttctttttttctgacctaattattttccagcgatttggttcattttattattatttttttgtctcctaagcaactatagagatcagctggtccaccttctgcctaaggatacctaaaacgttttatcattccacacttcctacatatgtaagttgttcagcttaggcaagaactgccctcatccttccacccagacttagtctctctgccaacccgtaatcttttgcttattcttcagctatttctttcatcctgcttagagagaagtttcccaaacattctgcacttattttcagaaggaacctctatgatttgtcatttaattgtgcttctgactctcagagacctcttaacaacaacgacaaagaaataactaaaacgggtgccatgattgtctctccctttggtctgcctcagccagcacttggctttgaaaaatactcaataattctttaagttcaattgaatcgtttaatcctaaagaacttttcccacaggccatttttccatatctctttagctatgctgacc

SEQ ID NO: 1169 - DNA, 216 bp, Homo sapiens
agggttgctttatgattcttatgtgatatgattctatctcaggatcatgctggatttagaaaaatctactgctaaaacccatgagttgtaatcaaactacaattccttgaagctgtttaatatacttctgttccttatagagtttgtttttcactagttttaggctgtggaagtattctcaattaaacttattctgctggacactgctttggatac

SEQ ID NO: 1170 - DNA, 973 bp, Homo sapiens
cagacctaaaatcagttcagtcactcaatgcctggacacagacttttgtgacaattttctactgtccttgaagttatagaattaggatcacatttttaaaggtaattttgtgagaatgtgattgagcttaatagatttatgcacattacttttcactatcagttttgtcccacaaaattactagaatcaacagttcaatctttattttttggtctttttagcattatattgttcttgtgggggtttaatataggctttaaaatttttttttgctgtgtattagataaaaatgtagagagcttccctattttcttatataccaagatatagaatatctttctgactttcagtgattcgtgtcctatgagtattcgaagatagaacctcgtgtaaaacttctgtctggtttttaatggtgttggataaaatctagtagactctatatttaacacaccagctcgtgttaatagactagtttgtttcctacctctgagttgcctgcctgaattttgaattcactgtatttgtaaagatcgaggtaaaagaagctttttagtttttttttttcttggtactatctattatcaacttcttttacccgtttaataaaagggtcacattttctttcattttttttccatttcttcttgtaaacctccaacttcacttgaccctgccataaagtcctagaaaaagtatataggagtttgaaaggcaagcagtttttacagcattttaatacatttcaattttgcagcacaatgaatactgacagtataatagagactttaaaaacaaaggtaaagcaaactatgaatgctgtcagaatttctaatttcactaaactcagcaggcgtaaggacgcattttcttgcatattagacctatcaagtaattataaaattgaggaatttaatcagcctgtatagcactttgagctcacatcagatttttaaaatgttgtctaaacatc

SEQ ID NO: 1171 - DNA, 1824 bp, Homo sapiens
gtttcagatgtctgttacttatagacatctacgtatgtaagtaatatgctgtagactagtaagattcatttcaaaaatctgactgcaacttataaaattaatgctttttcttggatggctataataaacttaccagatcaaaaaactacatccttttattttaataactgtcacctgggttaagaattatgcttagttttaaaaatgcaaacaatactactacttctaaatttattttgttaatgaagccactacataaatttagcactttttttaaattaattgctcacactgaaaagggctaaattcagaataactctcagtttcaaagacctaattgccaaggacctagccttaatattaactaggataattattatgcaaagcatacccacccagaatgtttgcatagctatcacaagcgctttcataaatgatgctttaattagtcttaattagaatttgtttaagtcagcagggaatgcagggcccgtgaaatgatgtatgtaataagcatcaggctcactttttacttggggaatagagctgacaaaatcacatcacgttaaattgattcagtcagaattaaaattcttatggtattaattaaatggaggatctcattagcaggctgcagggtgacggaacgactctttggcgaccagatgtgagggaagaatcacggaaagagagtatcattagaccaaaaagtcgctgtatcttagatatagacatgatgacattcagcttggtctaaagttgtccaactataaatactattaatataccaagaattcagaacaatttttcttttttttaaggtcatttgacttcttcaagcttctgtaccacactaaaaaattctgagtattcagaaacatttttatttgacaaaccaactcagtaaacttgggaaccaataattaaaatggatacatgttttaattactttttttaatgaacatgaaattctttgagaaattgtgtctgaggttcttcattttttatctacatttcttctcttggattcagtgataacagaagatataagttctatttagtcaaaaaataataggttattgataaatgtattcccagagccactggtgatttttttcctctctgctgtttggtaaggaaagaaagcacactttttgttatttataaaacagtttgagtttgcaagtctagtcatggataaatgatatttacttccaattagcatctgttttgtgaatggcaaggggcatatgttggggctgtgtacatttttggtcaatattaacaacttaaggctttggcttcattctgtcgtaaaagtgaatatttttcttataaatgctgaatgaatagaaaaatatggaggctaagccttcctgttaaaagacactgagctagatagctgatatttaaccacagaggaagtgaggcttatcatccataaaaaaccttgagttatggaacacaaagccaagtcttaaaagagaaaatcagaaaattaatttagttgttggtggaatttagaagttgtttatacttacaatgtgtcataactaaataaaggagtaagtgaacgttcgatgtctactgtaggcaagcatatatttggggaaatttccttgggttctgattcctatttatttaaaaaatggatagtagatttcttccatgttttaattgtggaaaataacattaaaggaggctgtagactgtgggtagacttcttcttaagaagggatacatgcttgcttccagataggactcctgcgttttagtctcaatcagtttcctctccccagtaatttttattttggtggaagtaat

SEQ ID NO: 1172 - DNA, 781 bp, Homo sapiens
catgaagaaagaaaatgcaagttcattccgagttgatcctttttgcaaagatgttgttatgcagaataaacacggagtgcagttcttctttaacattttcaaacacaaagttaagtggcttgttcttcaacggtgttatgtagcatatgccagataaaccaacaaccatactgatgacagggcattttgcatatcagtaactgagtaaacacacatactaagatgatctgcaaatggtcagctttgaaatgaattctgtgttggattctaggaatttatatgaggtctgtttgcttcaacattctatagacttattttgggctttaatttttttaaagatgtccaaaatgataatcctagtttggtgccacaatcagtcatgagtggaaaaaaacctcaacacatcctatttaggaaactggctttctcatggctatttttcttcttgaaaaaaaaaaaaaaaaacatatttgttttataactatgcctggagccaactcctgttttccttgcctttagcaaccgagaaacctctactgaggctttttgcagcctaaggaatatagtaaaaaggttacataaacattcagaaaaataaattaataaccccaagtcttcaaaatgtactgaagagggacaggctatgtggaatgcaattgttttgatttaggtaaggcctgctgtccaatatccaattccatttgtaaaattaatagctcctccatgaattgaatgatttaaacttagaaacatctccttggtaccacatgaggatttggtg

SEQ ID NO: 1173 - DNA, 43 bp, Homo sapiens
ggatcataaaaactttgccttacataaagaatgaatgcttgga

SEQ ID NO: 1174 - DNA, 1017 bp, Homo sapiens
gaataagttgaattaacttatatatgcaatgacaaaagaaaagtaaaattttatatgtagcagctggcggatcatttcttgagaccggtctgtgatcaaggaaaacagaggaaaaacacaaggcattcgaacaataagaaatatgtctttttgcagcagtgggagaaccaaaaaattgtaccaagagtggagccagagcctagagagacatattgcttgaggtagaattttgtgtaacttaggaacagcatcagagttcccgtgataacatgagaaaacaacagaaaatttgaaattctgggaaatttgtcttgttctgggaatatttgttgggagtatttaattccccaaacattgctttcaaaacgttctttggcataaatttgctcttaaaatgacatggctaaacttcctctccgcagtaaattaaattacaagaccaaataagaaccaaacaaaattatttttagaaagataggaggaagaaacattatgcatgtctgatttttgaaattatggcaaataaaagtgggaagaagcattttgatttagtggattaagctaaatcagaaatcatgatattgcatacatgaccttaggttaagtcccttttttgccaccacttccactgttgcaaaatggtcagaaacaactcttgtccctgaactcttgggaggttacaagagtaatttggtgagactttaaatagcagttgtgatatttaggatatgagccaaataagaaggccaggaacccaaggaatctgtgtaacagcgtaaccacatttcattaacgtttattagaaaaggaggcctttttatttcctggcaccacagacactaccagctgctatatttcatgcttacagcgtcccagtcaaaagttttaggtactttgaattatttatttccttcatacttccaaaactgctccctcaacatataattatttcattaattatacacacagcatctttgtatgacctgggaattttatatagtatgttgattataatag

SEQ ID NO: 1175 - DNA, 181 bp, Homo sapiens
attaaatatgtgtccttgccacagatggaggttcacactaaaaaaatggaggataagaatctgtttgtttgtttattttagcacaatgtgcttttcatctacgatttcttttagaccctggatgctctggggaccaacagctctgtaatacaccaaaaagaactagatattgatatgacta

SEQ ID NO: 1176 - DNA, 1029 bp, Homo sapiens
gatcagaaattttccctagtggtatagcactgcctaattagctgcattagggaagactcagcctttctctgagcgctggccacagttggagacaggaaactcacctacttcactggtaaggctgtaacacttaattaattaatggttgcagcatatttatgatcttagaataaaagggggctataggagtgaaagtattactatattccctcttattgctaagaggaaacgagctatttcggcaaatcagtgaatccagattgaaatatttttttccccaaagattgacggattacaaatatcttcagaatggttttcctttccattaattctagaaacttggattagtgtaatttgtaaaatatgatttatttttactatagaatttgatgcttatgaacaaatcttcaaggtataattacatgttcatattatagcaaaagctgttatttgctataatagtaatggtgaaggagaaagtgaagagtcttaatccaggaatgaaaattctcattgtccatatagttgagggttcaaaataatgatgatatgcatgaagaaaatgaggagacagccagacaccctccttaggtttttattcaaaataaaccccccatgcatattaagtcttacaaaaagaaatattgtctaagtggatagggttgggtttcaacctatactctgcttctactgtgcttgggatctaactgaaattcaactcagaacatctttctttgattttccatgaagtaggtacagtggataaaagcaaccaggtcaactaaaccactgaagaaataaaggtgggtaaagatagagccaatccaaactctagattaaaaacaaaggcaaaaagagaaatcaagtcgctaggaaactctaaagggagaaattaggtgtggtctctggcacatggaagtattagtagaatggcaaatagaaatccaaataaatgatgcattagttgtggaaagatgaactgcttatatggcctttctcttagcgaccttaaatagagaaaaatagtgc

SEQ ID NO: 1177 - DNA, 1278 bp, Homo sapiens
gtactgttttttttcctccatataagttctcccccaattgtcttgtctctgctacataaacccacctccaattctcaactactttgtgatgacatcataaatgcagaaaaagcatcttgttttctactcattttcttctccctttttaccagaaccatagcatggaaaacatatttacattgggctacttcactgaattttaaactccccaataccagaaagggacttaggaggtagaggggtcccgaatgtgttgatctacagtacaaagaacaactgatagagactcagcagaagaaggctttaaagaaaatcataggtatggaaagaaaaccattttctaaagtgccaagagcaattaccacttgcactttgaccttctcaattttagtaagtagtagtagaaagaaaatgcctgaacaaaaggtttgcagaaagaagacttgggtcagataaggaactcagctagaggataactgatgatcaagatgctttctgagttgcagagaatagggtatttccttgtaagatggtttcatagcgctcactgagttggtagttcagggagtggttacagtctatgcaagacaatgctgtaattttttttaaggagatttcctgttctcttttgtatttctaagcctctatcttcatcaaaaaagaagaaaatggtgatataatagtctggatcatccagtcaaaaattctcatttaagtacacaggaaaagttctaagcatagagatcctgttaccaagcaaattactgacacctaaaaacactctccactttctccatagatttgattttgaaccctctcctatttatgtttgcacttgtcttagtctctatgtttgtctacacattgttcattatgaaaaaagtataaaacatttgtatatgtaacatattatgtatttatgagaatatcatggatatgcatacacatatgtctctttggcccagttaaaattcaggaaatggttcctgcatcttgaacaaagtatgtatgttggaggtcatttttgaagtttagattgaacagactttgtatagtgagaattttctatgtttgggaaaagagagcaataaaatatagtggaataaccaaccaacctgtaatacaatgagtaatcccataaaattatctcagactaattgattcacctgacctcttatttttcatattcactgtttgaaaatatttgggactgcaccaactaatgtcttatcagctttcagttttattgccaaaacacttagggaaaacccagaaatc

SEQ ID NO: 1178 - DNA, 1449 bp, Homo sapiens
ttaaaaagtagcacaggctagggcctatatttaattctctttcttgtctgtggttcaaacatgttaaataccctatgaaaactgggttaatgtcatcagtgtctgagaactcagtgatcctataagccatgtaggttttgatggaggaataggtcaagaccacaatgaggtaatcaccagtgttggaagaagtgaagacagaaacatgagacatttagaagacaaacaaaagcatagggactctgatcttaaaagaaaaaggctggtggaaaaagacagtagtcactgggtggtgactaatgagaaaagaccgctttatgattctatgctcaccaagccctggtctgcaaataagaatcaggtaaataaaattacctacttcaggacccaggagatccgctgccatcaatgtatgaattaatcattaaatatttgtgagggaaagacatggtccttacctgcagagttattgtaatctagttagaaagcaaagatacacacataaacagttaaatctctccaaagcattgtgtgataactttcaggtgaacctgaaattttcaaatttgttcacactaaaatccatgcatgagtttcagtaactgggaaactgtattccttcctcccatttccccattaatcaagttataaacccagtcatctcctcagagaaaaatgaaagccacgtggaagtcttaagtgttgctcaaatgtgctcatgaattgttcattcatgttttctgttctaggttcttcattgatgtctgcaggacacttgaaaaatagtcccaccttttcagtggctgccagggccctccatgggactactcaacctttgaatgccatcactgatccttctggttggagtgcaaaggctacatagaagcttgcaggacagttgaggagaagacatgctctctaacttgtgtcactgggcatcacatcagctctagaaactgcactatttgaatagcaagtatcataaaaccactcttgaaaatatctccctaaacttttggttctaactcctataaaggtcagggggcttatgggaccaaatgagaactaactcagtgctgttgcttttatggcttgtgcttttctacttatccatctctgcatcccaggtgctagacaccctccctaggtttttattcaaaacaaaccctccatgcagatcaagtcttacaaaaagaagtggatagggtctaagtggatagttgggtttcaacctatactctgcttctactgtgctcgggatcagctgtgcaccacgctctcatgatatggtaatggaattcagaagggtggaaactttctctagcctagggcggtaggaccaggaaaggaataactggtggcacttgacctttgctgcaaatataattagagtcctataggagggaagaataagaaagatcaaagtggcctctcaggtaagagtggtgt

SEQ ID NO: 1179 - DNA, 263 bp, Homo sapiens
cttaagaaatgtaaggaatgaaataagatttttcaggggacaataaatttatcagactagttagagtagaagtttagttggggtggttgtttaggatataaatcttgaaaagcaagtttgtagagaggacgttgaatgatggggtattgtattaggactttaacagaacaagaccagcaaatatgtggcacatgagctctcaggagcttctccgtcctacacttagagtagacatcatcaattgatagctgctcttatctctg

SEQ ID NO: 1180 - DNA, 1355 bp, Homo sapiens
aagagcagcatggtgaaggaaagactgaggagaacaaggctagagatggggtctgctcaactgtccagggaagagaggaaagaggtctttgctaaggcagtgacaaggggatggagaggagtggactacaaaaaaaagaaaaacttcctctaagcaagaggaatcaaaacattttaccttaaaaagagatttgatggtttccaaactcatatccagctcaattaatcttcacacaaacccaccaagtcaagtaaagtcaatagtgctttacttctagaagaaggaatgggttccaggtggttgatcagaggtacgaagctccccccaagaaagactacacaccccagcctgcactttcccactgtaccaccacgcctgacactgatgagcttctgttttgcaaagctgataactatactcagaaaaagtacatgtgatttgagagaaatcccactggcaaagcgactaagtcaaggaagaggaattctcaaggaaagaatagttctttctgttggccagaaaaatagtactgctctgagagccatttttagaacagttaaataacttttaaaattacatgaaagatccaatcttatctgagggttttttattgttttgaaatattttattattttgtattttcttttctgtattttaatagggcctatttttacccagagatatgatttagagaattatgttacttgggagaagtaagatattttatgtatctcagagatacataaaagtgaattagccccttgaattcagaaatctgcatacctgtatctctttggaacaagcaatgttaagaagctaaatacagtaataagtgttctatctacctaaaattcacatacgctgtaatgaaagagttctgtgttcagccacttaactgagtatgttttatgctgaaaacatccagagacaacatgccaaggaggagggaacagtaaagatttttatagcaaacccatgatctttgaagaagaaaatcccctactcccttggcagtgaccaaaaagaaaaagcacaggggcattttcttcaaaggagacttccaggtgactgctgtaatgtggttagcagcaactcattgactcctagaggggtatccggccagagctgtgctaactagtgacatgtttccttatccacagtttgagattcttaatcataagatcataagggaaggaaaagcacgaggtacttgggtaacagttgagagatggtatctgtaagcagctggttgctgtcagactagaaccaggatataaatcctttcccaaggactggccaaattctttgatcttgcccaagcactatggaattgacaatcagaatatactaaagtg

SEQ ID NO: 1181 - DNA, 202 bp, Homo sapiens
gtgaattcttaatgccccagccaaatttgttcttcctctagtctttctcacctttagaagtgtcactgtgactcaccctggtactcatttctgtaaatgtcccttcatcttcacactcaatccattaccaagtctcaatccatctagaaatttcaaagcactcccatcaccctcattcactagcaatgtcaacatatcaagt

SEQ ID NO: 1182 - DNA, 119 bp, Homo sapiens
agatgagcagaaatcatggcttagggataccttttgctatacagacagttttcatttaaaaggcactagtatttaattccactttttaaagattaaatacagataaatattacactatt

SEQ ID NO: 1183 - DNA, 158 bp, Homo sapiens
ttaaaagtgctcactatttttccttacaactttattgtactttccaattttcctactgttataatcaggaaagagcaataaatattattttagaaaatgcctgcctcaaagttgtcatgaagattcttattatctactaatttgcaattcagatacca

SEQ ID NO: 1184 - DNA, 105 bp, Homo sapiens
acggaagactggagcactggagcatttgagaggctaccaccgactaagaactctcacttccacctttctcctcacaggacacccataaactctcgccactatttc

SEQ ID NO: 1185 - DNA, 714 bp, Homo sapiens
tcccgccactatttctaatactggcagttgctaattgtgatatgtctatttttttctttttagatactgggctcttgttacactgcctctgatagaagaaaatgtgtgtcttttgtatattttcaaagatgagtctgtgtcaatgtcatttactttagataatggtttcctgtttaatttgctttctctaactctcaccacgatgccatttttgttcacattagaacataataattaaaagaaattcatcacttgatcatcacaatgatcatgggagtggttactcctcatagatcactactaactgatttcaactgagacaaagataatgtaacaagtaatacctttgtaaccatcattctgctgtgggagctgaaagggggcatgcatactcatagagtaaaaaagctaactgctgctatctagagacctgatccctagtcccatatccagtgatacggcattgactaagactgattgagacacttggatgctctagctcttatttaccctccttgcctaagtaagattgacaacaagtgtcttcaccttacaagcacaaataggaatgcctgtaagctaaagacacaaacaacaaattgcctctgaggacaggaactagctatctgggaaaagaggtgagaagggtattttcactgtatactcttctatatcatctggattttaaactattgaatgtatcatctaataaac

SEQ ID NO: 1186 - DNA, 231 bp, Homo sapiens
tgggaatatacatatatacatagagacagagagagagatcccgtatatatgtaaattttttaaaaagaaagtaatggaagaataccataataatttaaaatagatggtttaaacccataatttttaaaacctatggaggaaggagaggcatagcatgaagatgacagggatagaagctaaccttctttgaatatttgtagatttaactttgaaaccacataaatactttgc

SEQ ID NO: 1187 - DNA, 112 bp, Homo sapiens
gaaaagtaatctccaaaactttaaaatgaagtgaaaccaatgtccaattggtgacataaccacacagtgaagaattctttcaagtaagtggcttcaaaacagaggaatttcc

SEQ ID NO: 1188 - DNA, 100 bp, Homo sapiens
aatttaactctacatacccaatgacaaaagtaattacaaagcaaaattaccacaaattagcttcaataatcatagtcttcgtagtagtgtcggaattgtt

SEQ ID NO: 1189 - DNA, 175 bp, Homo sapiens
ttgataagaactgggattttggagagtgagagaaagaagatataaatggtaaaagcccttcttagtcttgaattccaactggaaggatcagtatgcacacacgatgtaattattttatctaacataatcatgggaatagaattagcaaaacccaaactggaagctctaggacaaa

SEQ ID NO: 1190 - DNA, 1131 bp, Homo sapiens
caaaatttgttttaatattaaaattcctacactcccatgcctgctagattttgcttcctctaagttttttcaatataagcatattttttactaagtttctatgggttttttttttactaccatcatcatctactaaaagtcatttactaagtatctcatatgtgggcctcgatttaacaaaattcacatgtcgccaaagcgtagacataaaactacatggaattagaaagaaaatcaacttaatagagtcactttgtagaccaaaagacctgggcagcttctaacgaaatgcttaattaggaaccacaaaccttcccaaacaataagcaatcagaacttcttaaaaagccacccctgtaaaacagttattgctgctgtataacataatataggcccacctggaaagattctttaaaacatctggagtccaaatacatctgctacaggtgagcaaacaaagcctccataaagccacagaacagacaaaataagctgattgaccagaggggcacatttatgaatagcccattaggaagagggatacacagcacttctatccacggcacattctcaagaaaaggaagccacatagaagtacaatgaagcatcagtcaaaaccatcctcatttgcatttggtgcaaaataaactttcccaattcagacagacagcaaatatttaacaaggaaagaagagaagcaggtgcagtatttgagcaattggaaacgactcctggcatcattgagagagtcatcggtgggacatttaggtcagtgacctccagacacaactagtgcttttgatctttataaaaaatagaaggtattttaagaggggaatcatccttgctccccagccccagagttccaaccaaataaaaacacatggcaaggcggtggtgaaaaacctcagccatcagtcaaagtaagtaacacaagtaaagcctgaaaagtggttgaattcggacttcaggtgagatcaacaaggtgttgatttttggagtttctagttgatgtcctcaaagcttcaagacacttaaggagcagctttctgagtggctgtaagccaatatcttcgtaaatgtgtccaccatgccatctgcgccagaaccaccctgaggtgttgctgaatg

SEQ ID NO: 1191 - DNA, 428 bp, Homo sapiens
ctcaaatttgagaaccattgtacaaattggagaaccaggcccgaacagtgaaggttatcagaagatctcaaaatgccccacagcagaagcaaatgcttattatttttgctttacataaagtgcaagtaaaatcatttttaaattgcctgtctcatgtctacaaaacttggcaggaggatggaggtaagggttggaggatattcagtgtcagagattttaactctggctagaattcttatttttttactcttttgagttatataggtttagtgttcatgaaaaaaaaaaaagaattagcttcatgacggaagagactgacccattatttttgttgattacctatggtatagagtatatttaggcatctaggacaaagacatattcgtgttgcctactatgtatggaaagcaaatctcgagcaaaagctt

SEQ ID NO: 1192 - DNA, 738 bp, Homo sapiens
ctagtgtatgtttttaaaaagccttttgaaatcttctgtgcaaaaattgagcataaattgttataattatttatttgcccaacagcattcagccatgtaaccactaccgagcacctactagatgcagacactacactggtagacactgggctattaccatggtattacctgggctgttaccatggcattattatgcaaatagaacaaacataatacttacatgactacgacaggtagggaggggttctgcctgtaaaaggagtctttgaaaagggaactggggagaattattgagcagggagtgggacacactaaaaattatttgttgtatatactacggggaggacagtcaatacaggataatcagtcaactgaaatcccttactgtaggactctgagaattctatgagaaattctgggccaagatctctacttgtagagacttgtagggatgcagctttgaaattagcaagcagttagaagagatgatggagtatatttctctctctgatttagcaatttaaaagaaatcaaccactctctccccatcagttctcaattggcagattttgctagacttgtcaaaaactgactgagcagtatttctatttatcaggaagcaatcaatgtgagtagtgtgactttcctgttgctctccatcagtaaatggacataactcagctgggaggactccaaggtgccagtgagggcacctgtctgccccctctctgtacctaa

SEQ ID NO: 1193 - DNA, 614 bp, Homo sapiens
aaccctctctgtatcttgtctctacccttcctctgccccttcctgaaagccctgtattccgagtctctcccagcagaaggagaacactgataaatcactaacacgattttgattttagttatgtgttacccccataatgctgtgtgcacttttaaagaggaaacccaaagaatatattcctgatgatggtttcaggcaggaatgtctaggagcaggagagagatcattttgggtctgccaatcacatctgtgggtgcctctgcctccaagcctacacctctctgccatgctgttgcccatttcactctctggccatgcttagtgctcagccactctcaagtgccacacagcggtgcatggctctgccattgttggtgtctggagtaacagctgtggtcatttctttcttcggggagagccaaaactcaccctcttccctgggcactcctcacctctgctcctcagtcatttcctaatcaagaacaacttttagtttcctaaaattattaagaatgtcataaaggatcgggctggcatgcagaagggaagcactgagagtataagtccttgtctgggacaatagccaaagattttcccttgggcatttccctaat

SEQ ID NO: 1194 - DNA, 2372 bp, Homo sapiens
atatgttatcaatggctaatcagtgtatttaagaagcccagttgttaactgaaggagaggtaaaagggaaagaaggacctactctctgctaggccctgcacaggcatttatatttattaacacagtactgctcattcctcacagaggttcgaaaacacagacctttaaccaacaagtctcaacctaacagtccatgctaaagcccagcctgggtggcattcaataggagaggtagaatttaccttgttcccaagacttctggaaattcctacagggaaaaagaaatactgcctggtcaaggacttacgtcccatgtgattcccttcaccacttcatccccagttcattacaaaaatgttaaggatttttagaaactaaaagtagctcttcatcaggaagcactagggagttgccaaacaccccactgaggactctgcgccagaccacagacacaactcatgccataaaagtagataaatcaaacccatgtgtgggctattaaaattgcattaaaatatatatatgagcaaatgtagcccatgagatgggagctggctgctggaaaaatcactggcccagaacaaggggtttggccgttgcatctcaccaggccttcaccagcccccatcgctcaaatcctgcttgtctcccaaagtctaaaatgatagcatcggcattttgcatcctctgtctactgagatggaagcctctcgtggaaaaaattctggaaaggcatacaccagctcattcacagcagctacctctcgggaggaaattgtaggggaaagcaggagatacttttaaattcatgcactttgggattttataatctgtcaaaacaagcatgtattacttttgtaatttaagaagtcaatcatgagtcttttgttaagggttctgtggaggataaaagtaggttcctcagacagatgactatatggaaattctcaatgacagacaattgcagcttgctccagtgggaagcaaggaaaaacaggaatctcatccagctggtcgtcaccaatgccacgtcttctcaggacccagcgttcagcctctcagagggggcttcacacctgggcttctcttgtgttcctttagcctcgatggagcaagtgttcgcttcatcaacattctgctccggaaggcggtctgcagtgttccctgcaagactgcctgcctgagaccagggccactcccagactatttcaaacgatcccttgtttgcctgatgcccagggtcccgctgaacaaattggtttaaaccctcgagccctgttccaaaggggatacagcaaagggatttatgagaagtcatgtctgcagacaagaggaaaatattgggtaatcagagcagtcttgcagaggctggcggtggtaactagacgtccgctctgaggcaaggcagagaactgggtcatgttacctggactccatggcaccacagtgggtcccattcacaaaaccacaccccatggcccagagccggtagaggctccatgccaagggcatcttttccaaaatgtggcaactcagatgtgtaatcagaaagagtctacatttccctgtggtcagtgtctgtgactaaaagtgaggcaaggctggcattgcacaatgacttttagagttggaagggactgtgggtggatctagagggtgatttcagactggacttcacagagcccccagggtcagagccagcatctcaggacacaagggtgaagctaacggggtctctgagatgcccgctctgtatttatcaagagtggtttaccattgatccatgttatatttggcttcttctgtaaatgccaggcagctttgtggtccaatcttggtgtggagtcacattcaaagaaacagctgtcattcaaaaaatatataatctaaagcaattcaaatctatactcagtctctaaagaaaaagcccaaggggtgaagagtgcatttaatgcacaccaagatatctttaaaatccattactcccaattgctgccattctcaatctccttcatccagatggcaggtgcttcctgaaatcttatgttccttcttactttcacagccagaacaaaaactttccacgacaaccaacctgtgaggttcctccacctctctttcctcccttgtctggctcagttcccctttatgtagctcaacttagcctgtctgacttcaccagttgagtttttattttcccgttgtttgccctgagtctgccccacacagcaaagcccaggtgctgctgtagcccatatgaactcttggtaggcagggaaaatgaaagaagtctgtgaatcctaatacggtagtcatttctacctcattgcattgaagtcccacagaaaaaaatcatttgtaaaaggatatca

SEQ ID NO: 1195 - DNA, 1402 bp, Homo sapiens
ggccaatttttcataaggtttgaggtctggccaaaagtccttctgcttaaaaatatttctttctgtcaatcagaagaaatgtctcaatgtctgagattcccacattgtgttctcaaggactagttaaatataaatatattttctaaaacaagtaaactcttcagtcactaacaccagccttattctttgaatttatttctcacgttagctagccaggcaaccagtgatacctcgagaccttgggttaggagtgaagaaggaaaaacttccaaagtatgaagtgaccaggaggcaaggcccagagagagtcacaacgaagtgggaggaggggctagagcctgaagaaagggcagattcaaagacagacagtgatggagacccctgcccaacccacagccctcagaggaacaggccttgaaccaccagacacagccatcccagaagccttgagctgtcactgtcagtggacactgtggtcccagacgtatttttggaatgatgtatcccctgagggcacatcctcaacaaacactcctgacacagaaaactcactaactcctctctggtttaatgaccccactggaacttatcacttgattccaaatacctcacctatcctgtcacccagctctcttctatcccaaacctcaccctctccaagcctacccaactgctaccctttcgtctcctggaggggaaaagaacctgtttcccaacccagcgtaatgtgttcccatgatccagcaagctctggccctccaaagcctctccccacaacaagcctttttcttctcccacttgcctccaactgtcaattattagctgtgtttccagcctctgaaggagtttagctacttcacagtttcacccagggacacctttcctgcctaatattgcaaaaccacgctgtggaatacttgccttctcagggctctctaaatactgtctctaaatacagagggtattgtgagaatctaccaaatagaggttcccctgatatgtgttcaacattaacaccaatggcaatagcaatgacaaatatattgcagacgaatgctcagtatggacctgtcctagagcccaatccaaccccagtggaagtgggcatttattgcttgtgtcaaattcacactcactctcttctgatttgccttttggaattttcattcaaatcacttgtccctctcctggccagaaatgggttcacggcacagtgaggccacctctcttccccaggaatttgcatcttgagctgacagacccaaaactggaactaacaggagcaaattcctccagaaggctgtgccttacagagactggacaattgtttgagctccagaaggctgtgccctacagagactggacaattgtttgagaggcaacatgtggcaccacatgagta

SEQ ID NO: 1196 - DNA, 58 bp, Homo sapiens
cagatgttcttcagcacaagagtcctttcaatagtccacacaataaaaattaggctta

SEQ ID NO: 1197 - DNA, 1363 bp, Homo sapiens
attggatatttctgggatagtctgtattttctctgccttacaagatctgatgatccagttatttcttcagttctcttagctaccaccaatccttccagtaaactgaacctttgcttacgttgatcagtacctttctactacaatttatcaatttgaattaccttggagtagccagaggagaaagaacccatctgaaccaggtagtctaaacctacctgactataggacttttgctgaagctcagatttctcaagttactgagagtctgaaaacttccaacatcccactggcccagagtgacaagtgacctgaagcctatgtggcttccagcccagagccttcggtgactgccatcaaggaagaagccctgttgctccacttacttcactctgtgattttaggttgctgtgtttattagcgacttgtgggaagaatgttgtcagtgtacacaggttcaagtagagagtggtctcagagaagcagctaattagggagcagggtgtcaaactcaagtaaacaagacagggatgcttttatccttgtatgatccttggccagagcaaagacctcaagccagggaggagcaggttatggtaaatctgtgcctaaaggggaatcactacaaatggcatattcatttctttcttctgctattggtgaatgggaatgatggtatcagcaaattttgttccccttcatttcactgaggtaactgtctggtgttgaaacaggatgactcactttaaagcatttctcctcccgtctccttcttagggtcatggtgtctggttttctgaattgatagttcctttccttgtcccagttcccccaagtcccctgcctccagcacgctgggtctggcctggcttccacctttctgcctccgacactccgactaaagcgttcagagcaaggaaccaaggtggcttttcttggttttcttgtcctggagcctggtagagtgattggaactgtactccttgctaaagtgagtcttcatgcactgggtctaaggaacattgcctgggaagatgacttcttcagaatagaggagagggtaaatggatacaaaacataagcaaatgtcctgatacaggctgagacttccactgccatctttccctccagaagcgaggcaatgcagtccagcccccggtgcctcccagtgggctcaggcttctttgtgctactgtcctacctgatatagactagtcattgtcttcatagatgaccattacctgtgctattagttacctattttacttcaaattattccgctctttttcttttccttaaatgcctattttactctaagttcaaaatatccaatgcaatcataagttccatgtattttgtatttcct

SEQ ID NO: 1198 - DNA, 69 bp, Homo sapiens
acttgagtttagcctgagttcacctgagttaacccctatgctattcttcttgtcccccttttaaattag

SEQ ID NO: 1199 - DNA, 1602 bp, Homo sapiens
ggaaatactgtcaccacaagtcaacattatcccctctgatgatgaataaccacttaaaattaaggaagcaatgcccctagttttcattacaagcagcccttgctggttggaaaatctttccaataaaaagtagatccttatgttcctttgtgctagatattgttgctgttgccaccaatccaaagtaaattactgcatgaagtaaggtctgtttatactattccagtacctgatgacttcctatgcagaacattcaatgtgagcatctcagccaaaggcccataaagccatttcccccacactttacacttaggtgtgctaaacatctgcttttcttggccacctgagttgacgagtttcactttgcaccacagtgaggtccaggtgtcaagcaaggactcagacagtttcttccctccatgcctcaagaggggtctgagtttatagccctatttcccctgcaagagctagtggtgaggaaaccccgcagctgggcgtcattacactcaatcaatggccacgactttttttttcaaggtagcaggcagggccgaaggttgcattctcaaattttcagccaggttgaagctgtggccatctggaaagatgggtatgaatataaaccttgatgagggatcttttgttttgcctttttgggagctcctccaacgtgaaaacgcctcgagtccttaccctgggggtaatgtgttttcttgactgatcctgtgagtgtgggcaagcatctaatctcagcttatttctgcttctcttcgttatcaatttaaaatgagaataaataacataatgcttgtacagtgttttgatatccttgcaggaacagtaatccgtaatacataagtgaaacccttacaatggagatggctttcggggactcttacctgattctaacacccttcagtgtcagaggatgtcttttgagccctgtaccacttttcaccttggagaatacatctcatgtaagagataacattatctgataactggctattgtgagaggaaaggcaagataaataaacacctcctgatgcagaggaagcatctcctgaatcccacatggcttatctctgtacctctgctggccaaaccagagtctcctaacatgggaagaaagcaactcttttcctgaaacaatacaggctgtattttggagaccagatctcatcaaggaaatgattcaaaatctgttgcaactgcaccaatatactgatagcccaagtgttgcccttcactgcttttgtatttaataacatgggggtttttcaaggctcagtaacacctcagagcatgacagtaaaaatggaaaatggaccaaaagcataagtttacgttctttctgaaaggagatttgcacatgcggtcctgtttgacatatctctgtgcttatagtccagtcctgccagtagttttcctaagctacctccactgcctattgaacaggcatagatcactttttaaacagtggtcatggttgtctctaaatagccatattcacgtggctacttgggatttttcccttcaaccattcctttaatgcagagatgtatttaaacacctgtattttaaagatgggctttacaatgt

SEQ ID NO: 1200 - DNA, 1132 bp, Homo sapiens
ttgttccctgtccatccacatctcccaaagccatcatctttgatactgtgctctgtgttcccaagctaatggaaccagacatcttcctgtgcctcaaaccttcagccttatgataaccatgacacctccattataagcaagaaaacccagacatgtaaaggtcataaacctaggggtggttgacccagggtttacacctggctgacatccgagtcctgtatcccctctattaaacaaaccaaattctcttacctccgctctgagctatctcaatgggcataactaattgcccacttccctttatcagcagtgtcctcccttctttcctctcatacctgggagcccagcctctctgagctgcaccacaacctttttcctctgagtcttgtattttctcttttccaatgactctcctttcctatcctcctttccttctcttttcctatcatagccaaattcctgaaaagccaactatactcttcccattgctcaattccaatctgctcctcactcccttggaattgaccaccaaaaggacagcttcaattcactgctggtctattcctttattttttatcacattcagattccattcaggcctcaggcaaacaagtatatgctgatgttcatgcaattgtgtatgccataaagagatttatatccagatatacacttttgtccacaaatatttcaaagcatcttactaacaattcttccaggtcttttgttttccttttaattgctgaacaatttaagctacctggaagtaagaactatgtcctcttgctttcagtagtgggacttaggacaattgtataattaaattagaatcaaatattagattaaattcaagccatttctaccaaatcaaatcaactgcatttattctgttaatactgcagctcccgtaacttcagacaacaggaacagtatgtaagaagagctgcattatctaggtaacaacttgttttttgaaagttgctaatattacataaaaaccccactttggatagatggaagagagagacagaaagaagaaattaaattgttgttagctctatcaaaaacctggactgtgtgagcaggagtttaagggaaaaacaactttgaggcattgctggtgtgagtgtga

SEQ ID NO: 1201 - DNA, 337 bp, Homo sapiens
aaaaaatgagacaaacataggaaatgctattcaagatatgtaaaaaagcaaagtgctgaacagtatgtataatatgctaatagttatgagggtagggaaacacacaaatacatatatgcacacatgtacttacataagtgtgtgtatcaaaaagatgatagatccataaacacacacatacacatttgaatttggaaagactgcctctggtagcttataccagaaaataccctcagctattgtctttgagaagaagaattaggggttggggatggaaatttacttttcctctacatttctatgtgctaacttaaaagttttgccctgtgcaagtaag

SEQ ID NO: 1202 - DNA, 2408 bp, Homo sapiens
gcttaaagatggggtgaatttgaatcccttttttcccccagtttaaagagttaccgtaagatttgagaggtatgggtggacccgctctgaattgagatatttcagccactgatttaggatgaaagagggttttctcttgcctcccactggttttgtgtttcactgttttcagaacattaaatgaagtgttaccatgaagaaggcacaaattacttaatcctcacacaagagccagtctcattagctcacactcacacctcttaggtcataccatggccatcaattatacccggctgatgctgcaagggacaatctcactgctctgtgacatatttttctgtcttacagattctaggtctcaaaatataaggaatgacctcacgagtcacagcccagttgttcctatatgtagttagaaggagatatctgaaggttggtacactgttaatattattcaatcatttcagctctcttctcaacctctctattctcaacactcaatttcaagtttatggcaccactgcgattctagcccttccatttcccactcggaatttctgtgctatcgtccctcaggagctccttggatctggcatcctctctaccgtcaacctcacaccccaggcaagaaggggaaatcccagaggccataatcctccagccatctgggaggcacccagaagacaaccattagcagacactctgggacttcaggcagttctgctccttgaaacaactgtcactggagaggcgattttacagcagccactgttgtcaagtggaaatacatttttagtaataagaataacagcaatggacggataagctggctcttctggaacaaccatccagggatattccagccttacagttctatcaggtcaagcaaaagttgatgtttctacctcaccagggagcactttagcccttaatctcttttacaagcagcagaggacttgaagaccaaatgacagccagggacctggccattgccgggtagcctaggaatgtgcgaccactaaggaattgaagcccttctctgtgtctctgtttttctcacttgtcttctttccagctgtcctataggtgtggtaaatctgaatgcacaattctcaaaaaccataactcccactttttctaggtgccaaagagaatgttaaaatatcttcaattatccattctctcatttcaacttcagcttctagtattgattaagaagtggagaccacctcatctgtcctcctcaatcttattcatgcactactgagacgcacctacaggaggagaaacacttccaagcacacgatgtgaatttgtatctttacacacctaacataccgactattcctgaatccttatccagtttgaaagagaatacaatgcaagtaaaacctgaattgattttagcctgatgttttcccgtggaacagggactcataaatcactccatatgtcaaactctgcccttcttccccgattcagtaatcactctcttagtaacttgggagatataaactagacatttgtatctaccaggggttctatctggcttatttatttaattcagctgagaatttggggtgttatgtttcattaattcaccaatgacctattttaaatcaacgattctgagccaacttctttttgagatattggacttgatataaatacaatgcagaaagaagtaattctccattctgggttaacttcattattgtgctaagtattcccataagaaaaaaaaattatcatatgctctcaagcttcacagacatatttttgtctgtatgtttactcagaaaggagataaagtctacagtttcattttcatacttttacagcaagatcctaacccaatccaaaaaccccagctattttgcattaaagctaaaatcatgaaaattagttagaatcacaaattacgtctggctttcaagctatctgtaatgcacagatgtaatgtagcaaacacgttgtattttaaaaaaaaaaaaaacttaaaggttttaaaggaaggttggtgtcttcttcctttcttttcagaccaagtgctaagacttggagttcagttaactactattattcataatggagtttcaaaaattctaatgcaaggagaagataaacctctccaccaatgtttacttactggagaaagcgcaaaaaaaaaaaaaaaaatgagtatgcagatagagctttgtgatttaaagcaatagcttgcactaaatgcccccatcaaaaagtaaattctcaggagtcacctttcaaatccaaacctggaggatgattttgtattcaccactaatgtcatccatgatctcgtgactcagaaatactgagccacttcaggcacattggttttcctaactaaatatccatgtctccatctttaaaaagtttaaattcct

SEQ ID NO: 1203 - DNA, 142 bp, Homo sapiens
gtttaagtttcttttctgttttcactactcaactttaaatggcctcttttggtctgagctatgaggtcaaaaaaaaaccagtcagaactgagttttcagctatacatatttttacatccttgcgacaatactctgatgaaag

SEQ ID NO: 1204 - DNA, 452 bp, Homo sapiens
aaaagaaagaatacatgttctcagaaaaccattactgtggaggtttctgagtgctctcctctcatgatgttcctttcacttcaaagacctcctctccatgtatccaagccctttttgcattaagcactgttctgacagacacttcttctttccctaatacctagcagagcctacccacaggaccacttaaaaaaaaaaaattgtggaagagggatgctatgcttttctgctcttgaaggaactccaaattgtaacctttcaagattttcatgtgcccacaggatgtagctcaagttagagcagagactacactagatgcaacaacttaggttaatatttggtccaaaacttaactgtaactgttgtctcagaagaggtatacctatgcacaccctatggccacacaaaatggacttctgctcacccttcccccttaacctgaaagctaccca

SEQ ID NO: 1205 - DNA, 206 bp, Homo sapiens
actctaaatggactaagacactacccacaaacgtttcatcctggcttgctgaagttgttcgaagaggaagttacagatcagtttcttttcctgaaagtacagtctgttacctcaaacaaagtgtgactatcagacaatcaaacatatataaataaagcaaaaaaatgtaaaatactttgaaatggaccaaagttattgtaaggtgt

SEQ ID NO: 1206 - DNA, 82 bp, Homo sapiens
tttgtccataaacatgcaagtcaattttgttctctgaaaatacaccattggttttcctcccccactgtggaatgagacagtt

SEQ ID NO: 1207 - DNA, 163 bp, Homo sapiens
aaaacccagagaacagtacaaaattgttctttactttcctcattgaagaatccatggagtccacctcaggcggtcaaagaacccctcctgtctggtctctaccttgttctctcctcacttccactcctaaagtcttctcagtctttttagccatttaccctta

SEQ ID NO: 1208 - DNA, 295 bp, Homo sapiens
cttagggcagattcttaggcagccaattctatctgaaaggagaagaggagaatattttaattcttttgttccctcagcatattacagctacaaaaattaaataaatcttcccagtgctagtattcgtgatccatcagtccaaaattcgagtgtgttatgctatttccagtagtcaaagatcccttcggtgaaaggggaggaagagcagttaaaactctattctgccactctgtattgcctttcatcttttattaaaatgacaggttgctaatttgtccttccattaatgagaatg

SEQ ID NO: 1209 - DNA, 74 bp, Homo sapiens
actaatgaggatgtttttaactgatccccactctttcatctcatctattttatggcttgaaatgagttcaggtc

SEQ ID NO: 1210 - DNA, 205 bp, Homo sapiens
tagacctcaaagagctcacagtttgaaagggtcactttcacataaatgagtatttataatacaatgtagccatgcagcacataataaacctgtacattttcaggacaactgttctgcaggagacgtccagcctgtggctagttaacgcaactaaagtttcagcaaagcactcaagcgtaaggtccttaaagtttttctcattaag

SEQ ID NO: 1211 - DNA, 826 bp, Homo sapiens
gtcattaagttttaataagtccaaccatctccagaccagaacccctctgaatatgaaataggagaagtgagatatctcacacagtagctatcaagttactactcacaagccagaaaatgtcagggcttactttggctttcaagttcacagttccatgaaatacagagttaggaaggctatcttgatgagcattcttcattggacctctctgcctttggacttttctctgccttggacattcggggagctgttctgcttgggggtgcctttgttaagtgaaatgggcaattcatttccctgaccaccaagagacatccagaatttgtcatgttttatgagtaattttgaaagtgcttactagacctccctcccttttcaactgctcaggctcagtaagcttttaaactttctatttcgttacagtacaaacaactctacaagcaggcctcctgcttctcccctcaggctatgcagaattattcatactcaaggtctaaagaggaacatcagcacgaaggaaaaacagactaaagagtgaaaacaaattagcaatccaaacagctctctcccagcctgtcactggaaggcctttggtgtctcattccagagtcaaggggttttctgagttgaagattaaaggatacattttcagggctcagagaacagacaatctgtgaaatgcatattcacccaaggcagccagaacaaggtgcgcatatgaagaaccgggatgggccttcaccccaaaccagatgagccttgtatggatagtcggtattttgcacccactgggctcgagtctttcatattttattcatgcttgggt

SEQ ID NO: 1212 - DNA, 40 bp, Homo sapiens
gccattaagctctctttgggaatgtgggaaatcttatctt

SEQ ID NO: 1213 - DNA, 76 bp, Homo sapiens
aggtgttgctggcatgtagtgggtaaataagaaggagaaggctgagcaccctgtgaggcacatgatgacccccaca

SEQ ID NO: 1214 - DNA, 96 bp, Homo sapiens
ccttaaaatgtaaagcagtaaaaacagaacgttaagaaagctcctccctctctcatgtgtatatttgtgtatgtctctgtttccatctctctctct

SEQ ID NO: 1215 - DNA, 1386 bp, Homo sapiens
catgcaaatgcctgtgcaagagacactcagcatttcatgcagtagaaccatatgttctccactaccctcttttttctcccctaacattccactttattatagtagtgcatgctttcattctgtttttgaaacctctctttgggttatggcagagccaacgctggaaaatagacgtgtgtcatggattctgaagcgtctgcatattttcttcttgcccatcaaactctctagaaaatccatacagggcaccaagtggcagtcagcagatcgtgcgacataaaaattttctcaaagacgctggaaagaagctgcagaggcttttctttcctgcaagggcagcagggctctgctctgatcgtccttgcagagatgacaaaaatgatccaggacaagaatcttaatatctgtaatctaataaaatctactttcatgtccatcctcttcttgccagtcctttttcattcaatgttctggattgttcacaaacctatgaataagcttaaaacctattaaaaacctgcaaggcaggaaccatcactttgcttcttgttaatcacttttaatctactaccacaagtcaatcagcaacaatttactgagcaattgtgaagggatggaagaccctatctgcaaacaatcttgttcacttttacaaatggatcccttaaaatgtcctgttactggaaggatgcggacctctcagggctctagaagaagcacctaagtggattatctatgaggcctacatgaaaaaccaaacaagagcaacaataaatttgttttttgaatactgtgcagtatgacaaaccctgcctaagagatccgggtctgcatacacgtgtctctactgccatcttctgacgagccatccagcacagccatccattagcgtctgccacttgggaatccctctgagcactttagaattgaacttacaaagtaaatgggctttgaaaacaatattaaagcacaaatcatagtcgctgccacactagtaaacagttgagaacatcaataataatttttaagtttgcaggcaattcaacttaaaacagtacacatggagcagaattcctcactgtagtctgtgagcagacagccttgactgaacagtgggactcttcagggacccaggcaaggactatgggaaagtccaagggaagagtcaacaggctgtgatcctaacagctcaaattcttttggaatttttgtttgtctgttcctatgaggggaaaaaagaccaaagctctgagtctgcttttctgggtaaagtagaaatacagccaatgttcctacttaggcatcacctgagacatgcctagttctcctttcccttttgttcctaaaagcacagaccagattggcaataataacaatgatggtgat

SEQ ID NO: 1216 - DNA, 185 bp, Homo sapiens
aaaagatacattcttaacaaaggggcagtcatagctatcattgactgatgatgtattttatgctaaatcctttacagttcttatctaatttaacatctatagtaacctatgaagcatgtcttattatccatgtgttgggttttttttgttttttgttgttggtggtggtgttttttttttgtttt

SEQ ID NO: 1217 - DNA, 151 bp, Homo sapiens
attgctgacctccatgtgtttttgatggagagtgaatcaccagacttggcagatggccagactggccagagaggaatgaatttatgttgagttgaataagctatagcccatgaagaggtggctacataaaaataataataaacctccatta

SEQ ID NO: 1218 - DNA, 450 bp, Homo sapiens
cgtggatgcagcttctcttgccctcatagcttctctctcgtgatacatgttaggctgtcctacttcctccaggaagtcaccccacgttctcgtgagccaacaataccattcttcacacatcaacaatgtgagccaactcccacataaaatgccgaccaacagaccaactgcagggcatttcatcccgaaatatgtagcagctggatacagaacagaaagagacacgaggtggagacacgagggttcaggctggtttgtctacagtggaatggagtctcctaaactcaatggcaaaggtcacaggatggtcagctgtgagaagagagcagggaatcaagggcagcagcttgttttgtcctacaaacactgtcctaaaaacactgcaaaattctcatgttgaaacaaaactcctggatatctacacaaaaatctgcacacaaatattcctag

SEQ ID NO: 1219 - DNA, 160 bp, Homo sapiens
aacccccacaatattctacttagaatattgtgcttagaaacaaaataagttctccaattgttgggggtctggggaggaactcatggtgtttcatcaaaatgatccaaaattgattctgttctgatctagcctcttctcccagacatccttaactcagcaa

SEQ ID NO: 1220 - DNA, 246 bp, Homo sapiens
taccttgtttgtttgtctactctgttctcatctgccttacccactagaaactggatccaatcttttctttttattcaaacaccttctataaatatttgctttttgtttttgtttttgtttgagacagggtctcactctgttgcccaagatggagtgcagtggcgcgatcactatgaaaagatcaggtcacagggatacaaagacgaccaggatttgtagttgaccaggatttggtgctaccctaaa

SEQ ID NO: 1221 - DNA, 1032 bp, Homo sapiens
ataaagctctctccaagtctgagtcatatttgttctggaagaatcaaggaattttgaagacagaaaaatgaagcaagggctctccggttttatttgcaatgttctgtgtttccaaatcacttttagtaatctgccttttgagagaggcatcccctttaccaccctgcctaagaggaaaattaattcgataattatttaaaatttggtaggtttcaaaggaatgggtatttggagcacacttcactagtctttccccttttgttttaaaaatttgccaaagtaaaaagttgctttagaaagtagaaaaccaataatgacactagcaacctggaatgcagtagaggcagctatccggcatatctcagattataatattcaaatacatgccgaagacaaacacaatttggcatgctacagaactagagaaacaggtaggcctgagagttacttgaattttttctggggcagaaactcagaaatccaaaaatgatcttatttacaagcctttagtctgagttgacctttcttctttaaaagacatcgatgccctttcgttgtttcattttctgccaatttccaaatgttctccaagaaaaagacaacctctgaaattcaccaaaaaatgaataaataaaaaccctctaaatcaatcactaaatgaggaaaaatagacagaacttcgttaattgactcaggcttttaaaaattgtctctcctgatggggactgagggatgagatcttgaagctcacagaacacagagtgagtcaacagcggcatctagtgttcaatcagaatcctgcaaagcccctcgttggagatgggaggatctgtgtgttattgtaagaggcaaatcagttacatttatccactcgtggaaatcattgagaagcactcacccgagtgtttatggtgctgcttccatagatgttcacaggagaaggacgcaggttgtcctaattccagagagacggaacatcacacagccttggcatgcatctcacctgcatctcagcctcatctcagcttcccc

SEQ ID NO: 1222 - DNA, 493 bp, Homo sapiens
tccttggttctgcacagctgataatgtgagaggggttgctgctctcctcttgccgcaacccccaccccaggccttctcactcccaaaacctaccaaaacgtaccaagctgcctctttgaatctgctggcgtggtaaggggaatggtgtggcgcatgtgaaagagattgtcccaaatgggcagaaccttgggaccccagcaaaatcctgtgtttaagttctggcccaattgccaaagttcatccccagttcttgtttcagactagctcagaaattcgtctcattgatccctttaagggcttttgtatgcgactctgccacatcaagaaaatagctctactaccacccactcagaatatttgcagaatttgctttcttgagatacgatcatagcaaaagccatgcaggaatccccacttaccacagaggtccatttccagacatctcattgtgaccccactcctctgatggctgcagactcagtccccagaggag

SEQ ID NO: 1223 - DNA, 41 bp, Homo sapiens
ctgtcagggaaagcgttaaagtactgaactactctcccagt

SEQ ID NO: 1224 - DNA, 642 bp, Homo sapiens
gaaagggaagctctttaatgagattcctgcaaccagaccatggcacagttctaaattccaaagaaggagggaggacagacactaacacgtgttgagagctgacggatgtggcagcactgaagcagctgttcctggaaattcaccagttgtcttctgatctaaaaacactcctggggaagctcgtgaatacccacgggtgaagtgttttcccctgtactattctccctactagccattccccagtgcctggctttcagtgatctctgggtatgtgaactcgaaaccagcatttcagtagggaagatgtagtcaggcagaagaacgtgctcctgtctacccaagtgatgctcctaagtgtctccatgaatgtctatgagtacccaggaatgaatgttgtgtttctcatcctgcattggattttacagccttcattaaattttgaccaacaaaattgagtgagaaaaatcaggcttcctgcaaggaatgagctaaaaccagtgtcgggttctcactgtgaaccttgcatttccctttaataacagacatcagaccacctgcaaaaacattacgtctcactaagccaggtaagagtgaaactagagaaaagtagaggaaatgccttaagtcaaagttttgatttgt

SEQ ID NO: 1225 - DNA, 542 bp, Homo sapiens
acagatcccctgcgtagaaaagaatagcactgaggaagggctttatgtcctacccattcctcctctagcccccagccattcttagagaagggagaggtggcaaaaaaaactcataagaaagtttgagatatctaagaatagaagctttggggcatgtgactgaagttcaggagggcagcagccattatgcagcttccccaaatgtaacttaaagaatggctgcaaagactatccaggcagacaaggctgaggtgatctcatggagttccctcggaggctcatggagcagccagttatttcccagaggggcttagaagtctagagagagagccgagcccaaaaaagcttagtctgttcagccaattcccttggtgacctaatgggaatcagagcacactagcaaggacaatgtcagtgatgaaggctacagggactttatgccctccgtggcctctctctattcagtccagtgccacctgaaagcttcttggaatttacctgcaatgctggataaagaattggggtcctacattagctgtccc

SEQ ID NO: 1226 - DNA, 42 bp, Homo sapiens
aagaaaaatatgaagaaaccaactcctcctcaaaagaatgca

SEQ ID NO: 1227 - DNA, 88 bp, Homo sapiens
ttttccatagttaataacacatagaacctacaacttggtatcatgaattttctgcttaaaactgtatcacaggggaaatcatgtagac

SEQ ID NO: 1228 - DNA, 83 bp, Homo sapiens
ctggtgccaaaaagtttgggcaccactgacacagatggtagatcttgacctcatctgtatttttgaaacatctgagttactta

SEQ ID NO: 1229 - DNA, 131 bp, Homo sapiens
gccaccattaacatgccaaacttaaccaaacttaacatgccaccagaatcactaacttaaggcacagatgtattcagagttgagaagttgcctgaggactgaatctttgagactccttactcagataggta

SEQ ID NO: 1230 - DNA, 61 bp, Homo sapiens
gctcagaggtccagaagatgaaaaagcagcagaaagataatttctactaaatttctactaa

SEQ ID NO: 1231 - DNA, 64 bp, Homo sapiens
taaatgagaaactaataaaggaaaatgatgagtagtggagcaggccccagagtaacacacccct

SEQ ID NO: 1232 - DNA, 561 bp, Homo sapiens
ctttttcttttctcatatccttgaaataaagggcgttcataaaattatctgcaactcagaactccctctgtggagctaccgtgttatttttttgtcacagctcagggacaatgaccaggtatgccaatggtaattgctggggccaccctcccccaaagccaacccaatacagaactgctgatgccacagtcataaacaaaccctaggatgtggcccacccttcagtgtttggatttcagtgccaggggtaagaaatatgaaagacatggaaagaagcagctgcgttccaagacactccttcagataaagtttcctttaaaacatttttaccattcttcatcaatatttataaagagatgaatagatacagccacattcctcctgggctgtgtctcagacacacctataatatctgatcaaaatacaactattgtttgttggttcggggagcacttttattggcaagcttctttgaaaatgaggagccaagtcagccccatgtagcaaaaaaataaaatcaaaatcagttacatgagtacaaaaagatggatgtaatttttt

SEQ ID NO: 1233 - DNA, 278 bp, Homo sapiens
gggggggtatgatgaaagttattataaacacagagagaatcagcttttctagaaagagttcattgatgtatctggcctctcaagcaggcagaatgttagttaatacttgccaacctgttgaggtatcatggacccttaaggtttcatccagtattcatggtttaatctttgggaaacaccatgaaggacacctagcttctaaataagtctcccactaggtcccacatggcaactggaattcccaaatgacttcccttttgggttaaggggggtggttc

SEQ ID NO: 1234 - DNA, 328 bp, Homo sapiens
aattcaccattttgagcttcagtttcttcttcgggagggtattatgaaagttattataaacacagagagaatcagagcttttctagaaagagttcattgatttatctggcagaatgttagttaatacttgccaacctgttgaggtatcatggacccttaaggtttcatccagtgttcatggtttaatctttgggaaagatcatgaaggacacctagcttctaaataagtctcccactaggtcccacatgacaactataattcccaaatgacttcccttttgggttaagggggtggttctcatccctcacttacataagaattgcctgg

SEQ ID NO: 1235 - DNA, 381 bp, Homo sapiens
agtttggtcttaagacactaattgaaaatccacggctggtaaacctgtaagccgtttttcttaaaatgacccttgtttcaagaaatgtatcagtttagccactcagttccttgggagtgcaccacggggacataaatgggtgattctggacatgcagatgatgtacaacagagaaaaccctagagcactatagaagcactgtggccctacaccaagtctgagaaaaggaagaggtaacagtgataataaactcattcatcagcaacgtcaccatcaactaccatttacagagtcactagtagttgccaagtactgtataccaagcatttcacattttatttttatactcatgtggagactggagacagggtaggggtagta

SEQ ID NO: 1236 - DNA, 123 bp, Homo sapiens
ccaagaatggcatatatctgtaaaacttgttacattacaaagttggttgcagctggcaagactccatttgtatccatatggtcttcagaaaacacccttcaaatggttaaaaagtatattgct

SEQ ID NO: 1237 - DNA, 765 bp, Homo sapiens
taaaaaaaaggtatatagccaaagtttttttaagagcaagcatcttaattgatcatgttgtactgctctggagtcatccctgttttagttcgtgtactaaggcttgactacacattcccccgcctccaaataaagccaggcagggaggcagatgtaaatagtcagcggaaatgggaaacaaatgacaaccgatttgtaatacaacaaaaatatttgtttcacaagtttttctcactactggaatcaggtttctccctgggtgtgaaaagatgaagaactgagaaagaaggaaagatgagcagaggggaaaccaaaaggaagtggagaatgtgggagggggtaaagcaaatagaattacaattccgcctgtggaaggaattccaaatctcccagtctatggcagaatctggtttttcctcacacagccagctttgctttgaggttgttgctcatttgctgtcactttgcttcactgtcctagggggagcctagcccaaactaaccccacacatttgtactgggggcggggggagatgggggcacattctcctgttgtcactttctttttctcatccctaatcccaaagccaaggcttacccggtcttctggccacctagatccttcctgtctccttagcttaggacaaggctccagttccaggtcagacagtccaagcctattccaatcagaggtggtttttttgtttaaaaaaaaaagtttaaaaagaggggggaggtggagagggaggatgccatctattagca

SEQ ID NO: 1238 - DNA, 170 bp, Homo sapiens
catttaaaaggtttcaaagacaggtcagtactctacctgtgtagcaccttcatctctatctagcctactttctcacagtctggaaatgagatcagcccttgtgttcctatcctgcccctctttgtgagcttatgagtaacccaaaaggacaccaaagggagaaggacgtt

SEQ ID NO: 1239 - DNA, 873 bp, Homo sapiens
ttgtgacatcagagacctcttacaatgcaacccgcttaaattatctaatgtgttaccttcctgagtaaaatagcctttgtcctaaggaagaagttgggcaccttagcagaactatttttcaattcacaccacagacatgggtatctagcttctgggcctgctcattgcaggcttattgggctgttgattcaggctatttttatgatatatacatgacatgccatatagtaataatatatatgatagtgatataatagagaataatactatgacaaatatgatatatcataaaaataggagacacactttaattctacagtctggaaaggtagaattcaatgagggcaacttacctaaaattatggaaaagcaaacctcaaaaaataaagaaattattgatcctgtgtcaggttgctgtgcatttgaatgctgaaattgctctgtaagtatttcagaggcaggcaggtgatttttagtctaaaaaccaactggttaagttaaatcggactctgtggttctttgagaataccaacactgtttaaatatttcctgtaatccagatgtttaactccttgctcaaatctctttgatcaaggtgaatccacctaggaacattacaaaatgcagcctttcttatgacgtttttattgaatatattttttcatcatatcctgaagtcacctcctggtgacttgactcttagtataatagctctcttgtttcaagacagatcatatgtacatttaaataacttatacgagtttataaaaattgcttaaatgatccaactctcttctctagcattaagaggtaccactattctccagcttttggaaccaattttgtgtttaatggttaaagaactattatagc

SEQ ID NO: 1240 - DNA, 709 bp, Homo sapiens
tgataatgccttcctagctggctttcttggcatctgttgaaatggaatggagagaatgagtctaaataaagccatcaccactactctaagaccaattttgtgttccttatcaatcctagaacccatgtgacccagactcacatggaattacaatgaaagagacagttcaggagtaaaagtcacttcaatctctgattgtatctgttgaaggctatgaaagacatttagtccatagtctactgaacctttcttctctcttctcctcctgaccttctgccgtgattccagatcctcttactctctactctactctcaattcacccccaaggctctttgcaatgcctagcctaagctgatttttaatctatttccttttcttttaacattaatttacagcaatttagcctctcaggcttcctgtattttctgtttcgcctaattggaggtttcaacatattagaaaagaacctgggagctgactgttaagccaaaatctttccccagtgagaaagggaaggggaagaggagaagaaacagagggagggaggagacatttgaacactgatcattcctgtccctattatgcattaatggacttctctgctatagtccagtagacaagccgtccttaggagttaggaacatggtaatggcctgttaggaaagcagtatccaaactgtctctatctagtggtggaagtttatagag

SEQ ID NO: 1241 - DNA, 300 bp, Homo sapiens
aaacactaccctggacttctccaggctaagaagcccattgagctggatttgggcttgggatctgcctttttcttcctctgtgacctctgtcacatcacttaacctccctgagtctgagaggagatctcactggaggactttctgctgcagaatcccagagctcctcgtgtcaaaggctagcccctgacaaggttctcttttttgatttctaccctcagcgactcaacctgctttttctctccctgtgtctttgggaagctgccatcatttgctctgtccccaagtctggacaccatttta

SEQ ID NO: 1242 - DNA, 325 bp, Homo sapiens
caacagcaacaacagttcccatctctcttggtgatagttactggatacccctaagagcatggtttatattcctgaagttagggctcactaatgccaccttccctagacaccccccaaatgaattactcagtttgtccactaataaatgtatattagatgaacagcttacagaattaattttagttcttccctccaaatggtcaaaatgattgtttgcgtgtgtagatacagcttgaacagacagcttgaacttctccagactttggcttcaaaggctcattccatttcgttgggctggtattaatcgtgcctttttatttttata

SEQ ID NO: 1243 - DNA, 614 bp, Homo sapiens
ttctacccttaaaacaggcacacacattgaactggcagtcccaggatccacatagtcagcttgctcttggccaatagtgggttcaaattcactactggtatgcaagcgcactctgaaaatcatcactgtggaactgggtaaagcactttcccatacagaaattgttaggtaagtggcttacctgtaaatagaacagtgccccagcaaggcccacaatgtttctattttaaatacatctctctttactcgtgtcacttcctaacctctcctttttttttttccagcatgctcttattaattatgtgttagaatcctgagcagcaagttctttcattttaagtcattaaaaacttgctctaggagtgctgtgattgggaagtagagcctttacactttacccattagtgcccacacagaagaattttggtggaatggagaattgcttctgcctggcttctgattttgctggctcagggcttttcaggagagggtggcaatcaatcttgatcaacatgggacacatccctagatgcttcaatgagccagaagccacaaaaggagaagaaggaggtggtttgccggttgtggtggctcacgcctgtaatctcgctacc

SEQ ID NO: 1244 - DNA, 127 bp, Homo sapiens
ttctagagagcagagaggtactctggtactgacccttctgtgtgctggaaggacgaaaggcaagaagcagaaagctatctccatgccctggaaatgtgctcagcagaaagtatttggttacctaaac

SEQ ID NO: 1245 - DNA, 453 bp, Homo sapiens
acctaactactccatttgtgaggtccttggctaagaggaggaactgtaataacacaagagactaattagctgggagtaacagtaagcatttctgctgagtgttatcatcaacctcaacagtgtaagttgttaaaatattatcttaatttggagtctgtttgttttcacgtttttcggaaaacaaaatattttaagtggtatgtgtgtgttattgttttgtgcatgagcatatgttatattttccctttcttagccaagtttttgcttaagtacaaaactacttcctagggagcatgacacggggggataagcaatactcctcaccatggcagtggttcagaggcagagcacagagttgagaaccagacaaggccatgaaaaggcatggaggaatctttacccatcaatgcttcccagcctgggccaagctgtcttccaagatctcatcttgac

SEQ ID NO: 1246 - DNA, 117 bp, Homo sapiens
agagaccactgatccttcagttcgaatcaaagatatgccaaagatttttgcttctagtgcttgtgtagcaatcaccgtaagacaaatggcacagcaagcaggacttcactgttactg

SEQ ID NO: 1247 - DNA, 86 bp, Homo sapiens
atggtggtatcttgctagctcgctagaaatttaccttttttatcaagaaattaagatgtagcttttgaccagacacatccccatag

SEQ ID NO: 1248 - DNA, 484 bp, Homo sapiens
aagaaaggacacggtgctgctgagtggaagacgaggagggctttaatagtcttcaggctgaacttgagctgtcctttcaagcactgatctgaaatgttttccttagccattttcctgactattatatttttcaaatatttatattgataaaagataaaacaaaccctaaaatgtcaaaaatactctttggcaacaggtagcctatagagtttcccccctttttttttaaaccatcagtcatcaaaaagactttctattctgaatagacaataccagttcagattagcaaacaacccagagaatacttgtttctctttcttagtatctgaatgaaacaagatacttaacacaaaacaacattgttgctccctcctggtttcttaacataagaagaggcttgagctgttgacaaaaaaatacagaggtgagaaatatagttggtttctataacccccaaatatgaagataaaaaatgtgggaggta

SEQ ID NO: 1249 - DNA, 79 bp, Homo sapiens
ccagatatttacatttagactaatttgaaatggacttttatcatacatcttgtagatccacatgtgctctctggaccaa

SEQ ID NO: 1250 - DNA, 35 bp, Homo sapiens
ctttttttcttttcctaaataagtttatttcctaa

SEQ ID NO: 1251 - DNA, 111 bp, Homo sapiens
tgactgtggacagatcttctctcatagaagtagccctcccagctggtcctgattcaatctgctgaccttgtaatgaaacagaataaagaggaggacaatggggaggaaagc

SEQ ID NO: 1252 - DNA, 818 bp, Homo sapiens
ttcctgtgtaaaactcctttggatttcaggctgctctgtggtctctcatagaatttaggctccagagtgggtcctttgctctgagatctgaagacctaggaactaatgcctccaccttcagctttgttctaatctctcctaaaagcaagtatctagatccttttattctccctacatccctacatttgataatatacagaagcaagagcttagtaaatcaaacaagtgagctgaagtaggtgctgaaagttgacctaaaacaaactgggagctaagactctactccaagacagaacagaaatggacttggagccagatatagaacaagttatttatgctcagttctctaggaaaaggatggaggcttgttctgagatgtgtgcatcttgtgctgggggctggagggagctgctgttcctggaacactctgcaagtgtctgttctgggaggggcatcatggtcgctgcatcccaagccaggcatattgtgcatcagagtcaacgaatggaagtcatcagaattctggatgacactctgtgatgcttggatggttctctacttaaccccctgtggaggctgctgtgtatctgtttcatgccagactcggagaaaatagtaaagataaaagacagaaggcttatagctgttttcataaagtgtttgttttccttgctgttaagaccacttgtccaagtgaatcatttggggttatattttactaaagcacctcaaaaaaagccaaaatatttttagaatctatagctgtgggtgatccaaacataatgagcttcctccttctgaaaaaaaaaaaaaaaaaa

SEQ ID NO: 1253 - DNA, 394 bp, Homo sapiens
gcctaggttttttttcctccaaccctgcctctgagtttgaaacctacaagcaattgctgcccctccctcccaaacccttagtttttacccaacataaaatgaaaatgaagataacatggaaggatttcatgacagagatgtgtcatattcaggctgtggataattgaaatttacgattaacaattttgtcagaagaatgccttttagtccccggggtcctttattgtgtatgctaataggacaatttaggataaagacagggagtgggttataaagagaaaagcttcattatgtaagttaaggagtaatacaacgcattcactaatgagaagttttaacatattttacttatctacatttgaacagacaatacattcatatagttcaaaactca

SEQ ID NO: 1254 - DNA, 313 bp, Homo sapiens
tcaaactgtatgaaaggatagggaatgaaaagaaccctttcacatccttgttcttcacccccagctttcctgaggccatgagagctaccagagtgtttggtatgctgtcagatgtgtgctatggataaaccagcaacacacacatattcttatactctgttttttaatgcaaatggcaacattcactacactttgttctatgccttgtttctacacctgaggatgtctcttaaatgtttttgtttcaatgtataaagaacttccacgtacatgagccctaccttagaatcatcccccatagtagaggtttctc

SEQ ID NO: 1255 - DNA, 541 bp, Homo sapiens
ggtttctcttcttttattgttttctgcctctgctttcattgtaagccttctttagtattcatcttttatttcatccggcttaaaggaagaagaccagatctttgtgcagtagggaccctaagctttgaagaactctagtgatagcaggtcagaagaaaattcctgagattgggagcttgcacctttctgaagaaacagacatgcaacaggatgtaaggagaaaggagtagagacgagacaggaaatggaatcaagaagaaagacaaaggcagtgggaaagaaccaggcatttgcaataatatagataatttgggtgactgaactagtaaaaacctgtttttctgtgtgagaagtctgtgttaaatgtatagaggcagctaatatattagagcagtagagaggaattatgctgatgtacagactgaaatgtacatgattagctctagagattaatatagtctctatagatgtgactgtacgttgatgcagttctaatggctgatttggaaaataaaatcaaaatgattaaaaatgtacctga

SEQ ID NO: 1256 - DNA, 86 bp, Homo sapiens
aaaaaaacccacaaaaaacacccacagtataaaattgcccataaactgcaattattttaaggaaacaataatgaacaaagttgtca

SEQ ID NO: 1257 - DNA, 94 bp, Homo sapiens
acaggtatgggagaatgttctccatacatttctaaattaaaagaataattatacagctaaaaggctactctgtatatctattttattgatttaa

SEQ ID NO: 1258 - DNA, 655 bp, Homo sapiens
aggtccacatgtgataatgcctacctgtgtagtgaaaaacctaggtaacaaaatagaattcggtttttgaacagtgaccaatgcgggggataatgtatctctgcatgggaagaagttatcctcagtgggggactgaggaggtgggtgtgaggggattttgcctgtgttgcaatggtttatttctgataagcctaatatggataactaaaatcaagggtaaaaaactaaatttaaggagacctggaaaggaccaaaatgaatcaacttagtatcttaaagatgatataatcacaaaatatgccatgaaagcattcagattttttaaaacaacaaacaacatgcaagtgttaataaatctgaacttgcagtgatctactgtttattcatatgataatttctttagtttaaaatgattgcttaggattcattttataagtgtgctctcctcaagcactttaaactaaaatattaaaaataaaagagtaaaacgaggctgttacagacaaaacaaagtccaaaaacatcccaatattcagcttacatattgaataactgtgtgggaagacattggccatcttttgtaacttgtccttggaagtgctttcaaaaccactttcattattaagtattccacgttgtttttaacaagattatt

SEQ ID NO: 1259 - DNA, 43 bp, Homo sapiens
gacaaattctgacatttttgtttaaaaacaaagctagttacat

SEQ ID NO: 1260 - DNA, 1892 bp, Homo sapiens
gtgtgtgtgtgtgtgtgtgtgtgtgtatgtcatacattgagctacatttatgtactcatatccagaatttatgttaaggcatgtgggcacagtactccttaaagtacaataaacactatttaccccctcattgcgtaatggcctggagcctagagcaaactaaaataaactacactaatttttcagttgtatgttaaaaccttaaattcaccacataaatatcccaaaaccaactcagagcagtaagctgatggctggatagaagcacaatcagagggattattctgagggagcaggggaaacgtgtttcttgaccttctgttctgaaaggcttcttttcatctggtttcaattctcttgtttgtgcaccttgccatatttattattgaattcctggtttcttcttgttttatgttccatgttccaatgatttatgagaaattgctgatctagatgttatctttggcattcaaagagtgcacagagccccttaagaatgctgagagaataaatgtgttttgagctgcacaatacccaagctgaacagatgtccatcaattcatgaaaaatgccagctgaagatgctttaataagatgcatttttcttcaacacagcagcagcaagaatgttttcaaaatcgcagataattttccctctttggtagatgattgtggttagaaatgataagacttggttctaaaatattcatatgagaaaaactctggtcaaagatagattttttttttttagctcagaataaagtggcacattttttacatcagggaattgtcttgttaggttgactaagaaatggaatatgctaatgacatttcagttaatttctaaacatctccatgaagatgatctagtttaagtgagtagggggtgagaatttctttaatggtgaccagtttttttcttgcttaactaagtgaaaactaattagcaagtcaaatgtgctcagaagaagtcatctaattagataaattttacagactaatcaaagtagttagggaattttccctagacttccttctctccactatgggaggttaaacacatccccagaaaacattgcccttaccaaactttatcatcctatgcaagtctttctgtaatcaaacttgccaaaatattatatccaatactgtaatgcagacatgtatgcagattccttcatgggcttagtgttccgtgaattttcccatagaatttaataatttttaagaaggagatgtgtcaatatatcaagtcctaattatttaaaattacattcttcattcttttctatcttatttttcagagttaaatcagaaaagtaacacacagaataaagaaaacatgtaaagaggttaagaaaaactataataaacagtgtacttgccataaaaggtgtataataataggagaaaagatgtctttttatttcatgacaataagagagagaatagataccttcacctgtttcatcacacacatgaatcagctatgatggaacacctagagtagtcaatacttttcttgttagatagttaaacaaatttggcaagcaagtaaagattatcttaataaatcaaatgttcatttctgcaattccaaatactgaaatcactgcgtatctaaggaataatataaaagactgtagggttcctctgtaaatttcaagaattaaaggatatatatgtacatatatctcaatcttggctaaggaccaattttttattttcagggttgtccttatagagctcatcaacttagtttccaaaacccaaatgttaaatattctatggtgtaaaatgtttatatctagatggtgagattaagtatggttttcaatttcttctttaggcgttcccattttatatttttaaaaaactagtcaagtatggtt

SEQ ID NO: 1261 - DNA, 2392 bp, Homo sapiens
attttgtattgtttttatggtgtttatttttatagtgcttattacttttataactaggaggaaggatattgaaaagaaaatcctgggctatcaaacacacatggaagtgcacaatgatgagttttgagacagattttcacgaggatggcttcttacctactctacgttctgggattcagaaacttagccataaatgtaatcctgtatccatctaagttaggtacctagatgtattttctaagaattttgttaaaaagtttgattaagaactgatcccacattaagaaatgatttatgataaagttaataaacatttgagccaagccccaaagcaaaacaacaactatatagtttacaaacactactatattcccccaaaactgtttactctaggatacagatgaatgatccaccataaatggttatagaaactcctatggaagccccggtcctgtccagatttttgtattctctcataacctagttcagtatcatccacagctacctctgtatgcacaatggaccgtatcacatggcagtcttgagtcctcacgatagcacttgatttctttatattgtacttgaatccttagtatttctgtctccaattgtctaaatctcagactttaagaaacaatgtcttctttaactttgttgctaattgccagctacttcaatctctaaatgctgtatcacagacctttgcaaatgtaacactgttcaaatgctataaatgtccactcttgttccctgttacaaaatacctccttctctctcagacaatggatgtagagagatttttagacctccttgatttgccaggcagtggactgttttcatttataatgaagatagaagctgttactccttctttacaaactgactctgttttagcctaatgccagtaagaacttaggcctccacaccatttttacataagaaacacaatcattgtcagcattttgagattttaaaaaatagactttattaaaaatttcaaagacgaaacacagaagaggtcttacatcacatatcctcatcaaattgtttcaaacatcctcatcagagctaactatcctcccccgactctccaactttgctgccagctggggttttccttgtccccttcaaccctcatagagcccccagccccactgattccttttcctccctccagtctatcacctgcagcctgcataattatacacccagttatcagcaaattaaacttctttaaaaagtgaagggggttaggaataacaatgttattttcctctattccattcacattaagtgctcacaacaagcctttgtgataggtttcatcaccccaagtttgcattaaagaatgtccagagtacaagccaaggttctcttcagagtttcattctaaactattatatcatgtcatttcctcatacagtcataagacatctgtctaaccctcacataaatgtatgcaaaatgcccaaacatcaaaattcagatagctatagatacagggatggtttccaaaattcagacagctatagataacagggatggtttccataattcaagacaggaaataaccacagaattggttttgtttgtctttttgttttaataatgaaggagaatatctcaatgtaaaatccaactttggaagttgcctctttcaaaaaaaaaattaggacagcttatctatcccatctatcagagtcacattgaaaaaacaattttcaggcatcagatatttatgcagagtaacatagaatgaaatattcttaacccccagcatttataaagatgcatgcagcagcagataaactgtgtggtggggccatggaagtagaaatacagttagtaaagattctgtagtttaaaatttggtcttgagaactgcaaaaagagaaagtgagagagatctacattgttattattattctttatcaaaggagggaaccgtgacttgcctgagttgtgaacaactatgggatttggaaggataacaatgaatgaacctgagtgaaggaaaaatgggggccaattgcagttatggggaaatactagtgaaatgagtcctgacataaactctcaatgtcttccctgcttcatactcctagttgtgttctgcattccttgcataaaacaaaaaagagattcctttttcttacctttgaacagaggaaagggttgccaaagcaaaatctaggtatggtatggtgagaagaaaaatggcatgtgctctttggagatgaaaagggctgtaaaggcactggaggtggaagttcctaggaaactatccacaggaatgagactacacacatgttttgactcaccttaggtggagaaagaaaccattctcccatatgcagttgaattgtaaggagtgtatcagtcagtatgggct

SEQ ID NO: 1262 - DNA, 391 bp, Homo sapiens
aggaactgcaatgctaagttaataagggagggctagcaggttgtcctccctcaatttctctgcttccaaagttcacaaaggctgtccatgtgcctccatgcaatgtatcagccattttgatttagtttcactatggatttcaccattcagtaatgaagaggtattagaattaacatcagaaactctctgtacttgtaattctatgttcgttaaaagccacagatcaatactgggttcagtaaactgcataattcattacaaaggtaaatttagccattttcaggtaatgctcttagccatcttgaaataaaaatctcaaggaagagagtcatatgaaaaactaaagaaaaggatcaccttatttaggtacctgataattgcaagcaagact

SEQ ID NO: 1263 - DNA, 407 bp, Homo sapiens
cctattgaaagttgtgtttgttgggaaaatgataacattataatattagcttaaaaatacaaaattacaagattttgtaattataacaaaatttataatttgcaacaaaaatataaaattattcatatactgtagtcaaatatgtgttaaatgtatctatatcatataatatatatttttgtacatattttgacatccattatgaatagaccatttcatacaatggcactaaacagacctgtttcccttttgatactatgcattttatacatgcgtgaccaaaggactactattattttttaattaacaagacagatcaccacaaacttgctgacagcacaagggtataataagattttgagttgattttagaaagttggaagatataggcaaaatgcatgcatgca

SEQ ID NO: 1264 - DNA, 490 bp, Homo sapiens
tgtctgtgtgtttgtgtgtgtgtgtgtttctttgtaaaagaaaaagagaatattagggaaaacgcatttttcaaagttattagaagaaactgatttgatataaagggacttagcagaaaaaaacctagtgaacacattgtaaagactgagactgttttggagcataattcttgggtgtatattaactgcagagaggtaatcctatatattaagcttttaatatactaatgcatacaagactaatgctagttgttttagaataataataataatgtttgagaaatggctacaatggaaaaattctgaagggaattgaggtgattgaaactggaaatagaaatctgaggagaaaaccaatacgtatttaatgaagtaaaaggcatatttgtgagaatgttggtaagcagtgctttaatggtcatcaacattgattctattaaacatgtactgaaagcagacagatttcagacaaattagagagcattttcca

SEQ ID NO: 1265 - DNA, 273 bp, Homo sapiens
aagcacttcctaggtagcaaagtaacaacattctgggatataatgtgaagacatttggggagtcttctttctcagggtttgtttggcttgaaggaaagaaaaaatggccacctatcttttggggtctgtggtgactttccttttgaggaggacgatggtttctcctttagttctttcagtttggactgtaggttccttgtctcccttattctttccctgacttctttgaagacagcaaaaattaagagactcattttcttttttttaactttc

SEQ ID NO: 1266 - DNA, 153 bp, Homo sapiens
aagagactcttttaaaaaagaaatagatggttatttccagtcctactaatgataatgaagtaattttgaaattttaaaaatttcttacagcactctcggaaataacttcttgcatatttatttttcttgcttacaaaggtagaaatttattat

SEQ ID NO: 1267 - DNA, 670 bp, Homo sapiens
cacacacatgcacacaaaatgtttaagtagaattcaagtttaactgaatgtctgttttttttaatttatgaaatgtgcctcttttaatttgaaactgcaaataaaagattgtagactcgtatttaaaaatatcctaattgaaatactattaagagctactattccaggagttgagtttgatttgggcctttttgaagggaaatacagaaaacaaagttttattaagtatgtttatgtccacacagtatgtgagatataaagcctgtgcaaagccaaacagatgaacaactcaagatatttaaagagttagaaataacatggctattttagaaacaatttatatcatgcattttaataatggttctttcctgtttcactggaaaattcatcatctataaaatatcccttttagaaagttataagaagtctccttaacaaagatatagctccatctaatgggaaaaatatcacattacagcctatcatgcagctaggaattaatccaatatttctatgagtgctaataataattatatgtgtatgtagtttatacacacacatacacaaatactggatgtgtttctgtgcttctccttttttgcagccagataggatctaaaagttccttcaagagctgctcttttccttggattgaactaatgtaaatgta

SEQ ID NO: 1268 - DNA, 93 bp, Homo sapiens
catcagccatcatgctcggctatttttatttttatagttctttcaagagcatctcttttccttggattagacgaatataaatatatttttatt

SEQ ID NO: 1269 - DNA, 82 bp, Homo sapiens
cgtataaccacccacaccctaagctcattcccaccctattaatctacaaaatgtaaccttaagagtgtttaattttctgccc

SEQ ID NO: 1270 - DNA, 87 bp, Homo sapiens
caggagattctaatgtgcaggtgattctaatcccccagctgactttaacgtgcagccaggtttaggccctggtgaattttaagacag

SEQ ID NO: 1271 - DNA, 577 bp, Homo sapiens
tccagaaacagttactctatccttcagtccactttttagtttacttataaccttctcacagctcaatagcttccctcttcaccttcatcttttcacctctggcacaatgtggaaacagctcatccaatgcctaactcagtctccatggtttcaacccattatttcaacatccttataaaaacattcttagtactcctggagtaaaattttatttcacaatatgtctgctatttatgatccccctatatctgcttaagcctgtaatctttcaaagcaagcaccttcagatagcttcccgttattaacttgagatcaaggattagtctccactgtatagtaattattcaaggtggacaatgaaggtttttgtttttcttgccctaccacagagctgagaactctacccaaaaattatgtcatcattttttcctgcatttgtagtaggcattagcatcatttggtgaatgggatgcttgatgtaaaaagtagttacaacttgcctaataacacagtcaacatttttaggaaagttaacattagaatggaagactcacaaacccaatatatgtatatattg

SEQ ID NO: 1272 - DNA, 99 bp, Homo sapiens
tctaagctatttaacctttagtaataattatattgtaaaaattaaaatggccccagaacacccagatctgtgtttgcaataaatgaaaaattgacaaat

SEQ ID NO: 1273 - DNA, 94 bp, Homo sapiens
ttgaaaatattaagtaaaaatcataaagtatgcctgaagaaacctcatttattcctggctttttttttctttcacttttattttacttcgtgtc

SEQ ID NO: 1274 - DNA, 1532 bp, Homo sapiens
gagacttttcacttgatattggtaaacagctctgttttttaaatttatgataaatataccaatcatacagagatataaaggatggaaattagatcagagaatatcacaaaaatatgttcatcataaaataaataaaaataatgggtctttatatttgaaatcatgtctagaacattatctaatacccatcatttcattctaattagggccttataggtaaatagagtttcttgatattctattgttttatttcaagacaggaaaataaagatatgccgcattttaaaggtgcacagttgctaatgaagatacctgaaattcagctgtcagccctctgaaccatatattagatcaattcgacagtttattcagttagtaccactggcagaatttctccataattcttaccatatgtacttttttctgcatttcacttccctttttgctcttttgctctctctcttcaactttatctactttttgttgcaattgttttggtgattttattgttatcattggtggtggtgctggtgatagtggtggtttttggaacaattgcttttccttccctagctatctctttatttttctctttccatgacctaagaagcaaaagtgcccagtaatacacaggagccttgctttgttagcagaatttgtcatttgaactatgtgacctctataatcatttgttctacagatgccttctttaaagactcatttcggaacaagaaaaggctttcagacattctccaatgactagcagcatttgccatccatctttaaatgggtaattcccctgtcaaagacctagtctcctagataattatatgcagagaactattatttattttccctgccaatgcactggaatcataccaaataaatcatgtgctgtggtattaaatgttggtgaaataaatgaacatgaggttttagagtgacatgtcttgggagtcaaaagtacctatgagctaaggcatttatctcacttgttcaggagctgacattgggttcagtaattggaaattcgcatcataatattacaaaggacaaatattcacccatttccattgagatggcttcctctttaaaagaattatttagagagatttgcactgctctcttgatattgatagtttattcagctgttgaacaataacttaggtttttccagaccatcattctgcacatgttaaagaactcccaaaccaccaggctggcttagataaatatcagactctggataactttggtatcaaggaataatgtgaaagataatcctcttttcctaaaaagatgggatggggagctacttttgaaaataaggtttagaaataactattttactgtgagatatgtttatattatactaatgtatgcaataagtagcatacaattttattttaatcactatattataattctatgaatcttacatatagaaaaagaatagtaataaaatattctcatcttgaaaatgagatagtgtatggtggtttttcacttttctatatttcctactatgagtg

SEQ ID NO: 1275 - DNA, 225 bp, Homo sapiens
gttagggcataatacataaagtaacactttctcccttgtatctctttattatcattcaagttttcttgctattctgtcttaacctgtactgttccttcaagtaataaacatcaaaggattactgtattaaaattactcgaattaatatgctttattgtaaagtataattagtgtcaagtaattgtatcactagctcatgatgtagctcaaaatgtaaaacagaca

SEQ ID NO: 1276 - DNA, 108 bp, Homo sapiens
ctagattttggtggacttcatatgagcatgataactatataaataataatcttatataatcatttcctctgggtgcttctccagtgctcctaataagtttgatgctaa

SEQ ID NO: 1277 - DNA, 1275 bp, Homo sapiens
ctataataactattacagtcaagatgctgtgtctaaaaatgaaatctgatacatgaatatagtcagtcatctgaaaatatcaaggatactctctttttgctaaaaccaacaaggaagtatttcagttgaattatttttataggcccttatactattgtttatctatttcagtgagagtctgttattctttaacaaccttgcattctttcttgatgcagagcttatgttgaatcttaggactgtgttttctgaatggggtcaacatgtgtttaccatctggctttactgtgtgttactttcaaagtccatacattgaaatacagtagaagcctctttataccacataaagcacttcatgctaagttccattggcctggtcccctgactatgagtcatagtcagctggaacattgcttgagaataactttacaaggcattaagagaacaaaagattttaatgactggctcaaaatggtctggaattgtgaatgctttcaagaatccatttatatgttgtttcattaggagcatctgatgattaggagtatgtgaggggcatgtaacatttttttaacttgttcagacaaattataacagaatatgatagtaagtttcaagctcaaatttgcctgttaatcatatttaatctttctttgtaaactttattttcatagcattactgtattatggaaaagaaatagagtatgatattttaacccttggatcaatctcagactgttgagatcctttcagttctgatttagtacaatttcaggatgtaggaggacatctcaaaatatttaagtggttctataagcctgaggctggaaatgaatcacagaaccatttttcatcttgtcagtcgccgacatcatgcttaaggaattcttacagcaaaacaaatgcctattcagagaacgttagccattctattccttgatattaagtcaaagcagtagtctctacaaagaagctttgaaaatatgccactttgtaaaatgtaatattaatcagtatgttcattcctcacaaagataacactaaaatgataggaacgaatttaacaactcacacaccctgggccaaagaggcattaatccagaactaaaaatatgttaacattataaagatataacctatctggatttcatctagcgtaaaaagagttgtaaatctaagaggagtgattttgatatattattgctgatttctagatactctgaggaaaagctataagatttagaggtagacaagccctgttgatcacatccagtc

SEQ ID NO: 1278 - DNA, 93 bp, Homo sapiens
ggtcaatcacggctctagttagagtctggtggtgtggccaagagtgtaggagctatctttggacatgttggtgagaggtgggtgactaaaggc

SEQ ID NO: 1279 - DNA, 128 bp, Homo sapiens
tttatttatttaacaattacttattgtttatatattataccaaatgctgcgacttgttggagtgcccacatgcttcatgtaataaacaaggagatgtattctaccaataaacacctaatgatcagtat

SEQ ID NO: 1280 - DNA, 865 bp, Homo sapiens
acacctaattatcagttgctgtttttacgtgtgtgttgaaatcaaatgtaaaaaacatactgttaacctcggtagtattgtggaagaattgataattctaacataggtataaagatgaccgaatttctatctccatcaacttatgtctggctttcaagtggtcagcaaagtagaatcacagccattatgattccagcaacattgaaccagatcataaatcttaaaattcacatatattcagcacctagatgaaacaatactcaaggaataaaattcttaagaagagagaatggatttcacggtgtaaattacattctctccaaccctctggaaatggtgtattgtttaagacttgccttctgcatgggattcccagggatgaggtggctacaaataaaatgatctaatttatgtgcagtgtaagaaacgcattcttttcatcctacttactaactctaatttcctgctttcatagagaagacataagaaaaccactgaatatttaaactgtattttacaccatggctttcattaagagtattttctgtatttaagaaaatctcatagattgaaaaacaacagtttgaagatatcaaataccttctcccttttatccagatatgaacaaaccgatttagacccacatctgagcaaaaatgatcttatacataagtgtcaggaaattaataaacatgagtttgaaatgaactaattctttgatccagggatcacctataagcattgtttcagggcaattaaaaaaaactgaggtcactttcgaaaactttcctcagctactggcaaatatgcaatggggtattcatttctttagctttattaccattaaagagaatttattattaat

SEQ ID NO: 1281 - DNA, 1141 bp, Homo sapiens
gaaaagaatgagtttctgaaatggctaaatgtatgtcattaatagtaattcatacttctgtgtgaacaacaatttgagaataagcttttctatggtcttaggaaagggcacatgtgactcctgagacctgggaaggttggagagaagagcagatatctggaataggacaatgagaaagtgcatgaactctaggaacactgaaggcaaattcaaccatttcacaaacctgtcttgaaaccacttttataaggactcaagggatatctgagaaggaaactagaaaaactgcttttcatttgttccttgatgatgcacatttcctaaggctaacttacaataaagactggatttcacaatatcaaaagagcataaaggtattttaactgtaaataacccctttagcacagaacaaaatttgaaaataagtaaatggatatccttaaaaaagatcagagaagaagaagagaatgagaaagggaaagactcacattattattaccattgtcaccatcatcaattcagctcaataaccactgaaatcaggtgtttcaagaaattttatcacaaaatacaagattgcaaataagaactatatgaagaactatattggtgtaaatgatacaagccattgaacacactaaagaagagaattatgctgcaaaatatgtgaagaatcaaccgcgtgcgtatgaaaagcagatcaaaataatgagatttacagaagtagagaataaacagaaaaccacgattatctccaaatgatagatttctaaaatacattaaatacacattatgcataatataaaggtaatttcaataagcttatgctgaaggaagatgctgttgattctaataactgtactgaatcagtaagtaatgcatcatcctcttgctgtcactttcatttatgaaattcaaattcatttctcccaaaagagatagaagtaaggaagagaaaaagaagtgaaaattataaccctcccagatcaaagaaaacaatttcaagcaataaatatgagtaggaaaataatgtcagctcttgaaattatatatctcattcttaggacaataaaagtaatctttccatgtattaaagaaactttttaaaaaataaacttgagaaaggctagacaaataatct

SEQ ID NO: 1282 - DNA, 138 bp, Homo sapiens
ggctaggcagatgtgtctcagggtctctcatgaagtgacagattgcaggtgaagatgtggacgggggagagtagagatgaccaaccatccctctcttcatatagtctcatagcttttccatgtgacctcttcacatta

SEQ ID NO: 1283 - DNA, 127 bp, Homo sapiens
aatatgttacaagtatattttttgctagactgtagcaaaaaaaaagacaataatgtggcaataaaaataagaaaatatctcatttaattttctcattacccttttaatttatagtttcaaaaattgg

SEQ ID NO: 1284 - DNA, 142 bp, Homo sapiens
ttgtctcaggaattagagaaaaggggaatttgccaaatcaattttatgaaggctttgttgttctgatattcaaacacgacaaaaatttattaacaaaaactgatgccaaaacaataaataactattaacaagtatacacaca

SEQ ID NO: 1285 - DNA, 405 bp, Homo sapiens
aaagtcagtgcatcactgagttcttatttattataaaggtctgtttctcaatagcacttttgaatgagagctcagcattagacccacaaaagaaaatggtgaaaaaaatgttcagactggtcccaccaaggtttactaggcctgcaaagataagacgataagacttgtggctttttcatcaatactgctgcacaaagatagtattcaaccttactcatatcatcccattccttatcagttgttacaatgttatttttattgtatttaatctaaatgtcagttttctcactcaacagaaaacaaagtctccaatttaaagaagaaaataccgtcagatttggattcctttaaataccctcccctccatgtcaagtttatcttgaagcattcttatctcatttcatt

SEQ ID NO: 1286 - DNA, 415 bp, Homo sapiens
ataacccagctctttagtacaactctctgactaggggcatgatagttatatacccatccctttgtaagagatggccatcttatagcattctttcaagagtcagtgtgtgtcatgaaaaaagttttttttttgatgggtgtttccagctcctccttaaaaatattcagtcacctggctgcagtaaaatgccgccagctgggagattcaggacagaaatgttttcacttctctctcaagcctacatggctttctgagtacacattctactaataattaatctccagttgtttctcctggttaagtgtttatctcttaaagtccagcatgccaagctcagccaaagagctagagatagcagaaaaaaattataacagcttattttatcataaatagtcccacagacaattttggcaac

SEQ ID NO: 1287 - DNA, 430 bp, Homo sapiens
gccaccctatggttggttccaaagttgtcaaaactaacaactgatttggggatcctactttaattcagaattataagcttcctcatgtgttctgagtgtgacaggagtcataggtggagatttcttgttaccagtttaattttaggcgtatagtagcccctcccagtcttgataatacagaaatacatatctgaaatcatcacagtcttgggtcatgatgaatctttgttagctgtgggtattcttgtagacttcagattaggacctgatgcaagaatagcagctgaagaggtagatggccagataaaaataatggattgaacatacacatatctaatttctctcattcctaaaactacataaaaatatttttagaagacatacactaaaatatgtggaaaagagaaaaaattaacaacatttttcggca

SEQ ID NO: 1288 - DNA, 756 bp, Homo sapiens
aaatctagtatactgaattttgaaatggcaagaattatacctaggagagaaaaatcttatttttggagactgtaaattctaagttgatgaaaaatttatttggggatattatcttcttgagattctatgactataatcttgtatgataaatgaggcaacttagaaacattcatttatctcaattcctacattaaacaaagatggttttaaatgcagactcttgaatgactattataatttgctttgtacagcagctaatactgccttagtgttataagagttaaataataactaaataagatgaacatttttaccactttttcagttccaaatcaagtgaattcccaataacttgagagattaagcaaatgtaaactgagtttcatttgtataaaaccaatctgggtaattcaggaaatgtactttgtagcttgctatgaagatgtctttacatttgacagttctcagacatcagttgtaacagaatgttgtactttcaatattaatttgacaatgttttgaattactgctcatttttgcataatattttatttacgcctgaaaatatacctttgtctcataattacaagatggtcagctaaaagttctgttttcaagtgtaccaaacagtggccaatacacttccttctgagaaaaaaaggaatcacacagatatccttaaaataacaccttctaagtgttaaaagtagagtcaagtaaataaacacacatctttactagtgtccttttagggac

SEQ ID NO: 1289 - DNA, 1008 bp, Homo sapiens
tataataccaattgatagctgtctgaaatcctacaatagggaaacttttgatatgaaaattgacaatgctacaaaagagtgtacctagatccagctaatggtatggtctatatttcgcaatatttcctaaagaaggattagatcaggcatatgtgtgctgtatctgcaaaaatctggagaagattggtaataccctacccccaaaatctgtgtgttaggttaaaaaccacttatgcagatggatctgattctgctgattcatcattcccattgtcattacacagatggttctaaggtgagttaacaatttaaggcgatgtctacttggggttaccagatctcctgtgctgtcttgaaataatcatttagtcaagttccatgtggctaataaagcagcataacaacacacccatacactgacaatgcaaactaagatggcacaagtgccagccttaacaagtcttcagattagtattgcttttaataaataaacagaaaattctcacctctttaatactttggttagacaattctataaaaatgcagatctcattaattttccattatactcttagtaaatggtacattgaagagaaaattcttttctgtacgtgcttcattgcaactaatgtacttggtgctgttttttgtgattgctatttatttaactaattcttactaaggatgccatggataattttctttttctttattctccattttttagcaatatagtgggatacagagcccttttgctttctgacttcacacacagtgcaggtgttttagaatgcagattgaaactaatcactgggaaagaagtgaagagataatatgctaaatatgtgaatctgactgttcacagagactgtattacaaaattgaatgcaataaagtaattactggtttgtctgataattttgcaccaatgattaatgatgaactaaaatcagaagcaaacgattgtaacagcttccctcaataaaaaccacacttaattttttttct

SEQ ID NO: 1290 - DNA, 111 bp, Homo sapiens
ttatacaaaaaatgttaaaaaaaaaaaaaaagtctaacttaatcctaaatccttaaccctaaaaaaaacaaaaaaccaaaagaaaaaagaaaagagttccttcccacctcc

SEQ ID NO: 1291 - DNA, 96 bp, Homo sapiens
ggggggaatgtgttccttgcaatattaccgcatgctctttgtctgtatataatatgcaaatagaagcatgcagctagattttactttatgtaatgt

SEQ ID NO: 1292 - DNA, 192 bp, Homo sapiens
aatgaccgtacttgtatataaagatgtatacttatcgccaagtatttcttttggacgtaaagtagtagtttattgttattttgtcattatgtacatgtccaaatttcttcacaaatgtgttgcaccagtttataatcccatcagcagtctatcatattgtcctctgtgccacatccttaccatcattaaata

SEQ ID NO: 1293 - DNA, 1094 bp, Homo sapiens
aaagaacttcagcagtgttatgcagggacataatatagtatttcacagttatggtcaattttctatataattataggtcagatgtatttcccttttgtaaattttatctctatgtcctcatcatatttttttatcatgacttgctgaatcatttgtgaataccattcaattcttagcacaaggtttttaaaactgtcttaagtatttttaaattctatgtgtttttttttaaatcaagtgagtttgtttcaaataagcaatagtaataccccaatatttgtaaataagcacaagattaggcatagaaaagaaaatactttttaaatctcttgctttcttctttcacaaagacctttagttataatttttttatttgcatctttcacttgcatagaacacatatattttgtatgagatccagagtaatcactttcctctaagatcctcttcacctttttgagccctcactatgcataatagatgtgcccacttacacaagtacaatgagatgtgatgaagtaggggaaagcgtttttttgtgggaaaagagtgccacacatgttttgaacgtacggaatttgaccctaagtagacaggagtcatattccaaacaaataggtctctatggtggtaactttcaacaacttgaactatgacgttcattttaaaagaataacaagataattgacaagtttttcataggcttttattggagagagggaagatgtccatgaagtaagaattggtgttgaaattataaatgctacattgtttggggaattccatgtccagaatctgccctcttaacaacagggcaattgtttgaccttcaacttttaacaaattgtggttaagttaaaacactatctggaaatcctacagtaaatatctgcatgctatttgcaaccatgtcaaaaaatgagaaaaaaagcatgctaaaatgtaaaaattatttatccaaatcattttgatttcgtaagagtaataaagtaagtgtaataaagacaacatattttttaaaagtagatctcatgcatatatgcaaacattttccctgattataggtacaagggctcatgacatagtcatttaaa

SEQ ID NO: 1294 - DNA, 30 bp, Homo sapiens
acaaaaaatgcttccacttgaacataattc

SEQ ID NO: 1295 - DNA, 102 bp, Homo sapiens
ctttcataaaaaactttaaagaactataagccaaaaattcaaaatatttgaaaagtaatgaacacatcgtatactgactttgtatataaactttttaccata

SEQ ID NO: 1296 - DNA, 223 bp, Homo sapiens
gcctcagcctcccaaagtgctggggtgtgagccactatgcctggcctaaagtttcaaattatttgagtaaagtggattacattgatattaaaacataaaaaagattgaaaatggacaaacaaaatgttgaccaactttccttatttaagaaactctcaaatagaatattgtgaagactttgcagcagcacattgaaataacaatacatcaagaacaagcaata

SEQ ID NO: 1297 - DNA, 155 bp, Homo sapiens
tcctgttgggggataaaactggggaaactaagtggggaaaaaaactggaaagcaaagaaaacatagatgtattacttgataatgttggagtggagaagaaaggccttttaatcatgacataaaatgcagaggccaagttacaatggtgatgatta

SEQ ID NO: 1298 - DNA, 831 bp, Homo sapiens
aataatgcagaggccattaaagttagattgataagatctaagcctgacggtctccatttatgacaccgctatctactgttttttccctgttttgctgaaaccagatcttctccctaatagcatcaacaaagtaagttttgttacttttacctccattcatgaataaaagtccttcctgatatcttatttgattcaagccctgattaaattaatatttttcaaaaccatcatttttctaaaagtattcatttttctaaatatatctggtgagcctaaaagaataatttgattaaaaactaataagatgcataaagaagaaaatgtttctgcctataatatcttttagtaaagattcgaagttttgcaaagatactaatagactaacaaatggttttgttttatattttaacttggctttttaaaaaaacttaaatctgactccctgattgtatcaataaaatgtatcaataaaaatgagggaaaagaacaaagaaaactattttcaaagatagatctcatcaaaaacaaatatatctattattagattctaacttggaaaaaaaatttaaccttaacttccatatagtatctcttacagttttttgttaaaatattttcttaatgcaagtcaagaccaacttatctttacagatatatttagaggtaacttaagatttaggaatattaatatattaacctttttcagtgtttactgtcactttcatttaatctcttaataaatcctgggctggattaactgaataaatgagtgatattactgaattctttcatttgtgagtagataaattctaaccctaccaaagatatcag

SEQ ID NO: 1299 - DNA, 139 bp, Homo sapiens
tagataaattctttcccttcattcagtgttttaagcttctttactcagatctaatttgactgactgtaaggcaaatataaagtcaatctattgatgaacaagatgctatgaataagaattttaaaaataaagttatatc

SEQ ID NO: 1300 - DNA, 366 bp, Homo sapiens
taataaataaagttatatcaaatcacataaatctgcttttgtatataaatttggaaacgccaaagacatttttcatgtcagtctgaaactcggctttaattttaaaataatctagctcaggctgaaaaaactggaataagaatttggaatttaccatctaataatcacggatcttgaactgtggggatgactgcagaaggaagactaaaggaagtcaggactttgctgctttggaaaatgagacaacactgttcaacatcagcaaaagactgataatgacagagacaaatggaaaactctgatatgtaattgtgaaatattaaaaagattgctgtttatactctaagtcattctcaataattagaa

SEQ ID NO: 1301 - DNA, 445 bp, Homo sapiens
aggagaagcacaagtttacttctctaagtaggggtatggacaagatgatatattatgtttgtttttttatatcagactttcgattctgtaatgtatgaagaggcaaaagaggtccttttttccctgtaatatcaactttatccttttttattttttaaatatcagagaagtgagtaggaacagatatcaagttgagtcgttccccaactctgtttcccacacagtctcttgggaaagagctgccgccctgactgtaagtgctccatgaatcaagccctgggattaaaggagagcttttgcaatgactctctgaggttttggctctgagaaggaatgccggaattttaagagtttcgacatattctgtatcattatatccctatgcttcaataagtttaaaataaaacttttagaagaagtgtttcccaaatacccaggcactgag

SEQ ID NO: 1302 - DNA, 479 bp, Homo sapiens
tgcatttaagagcaatgggaaggaggaaacttgaaagtaacctaatgcctttgcactgcaggcatctgagacctggaatgggaccccatttcctcacagcactgcaaaacccaccaaggctgtatctcacaaccttctgagggactttggatattttaagttgtttctgttggcatcatacagcacagaatagaaggcctataataagaaaatagaataattctgtcctcccttcacctcctttcctcactacttctcaaacgaatcaacaacaaaacaattttggtggtttttcaagaaaggaatgtgatgaggcctgtttcatttttaaaacagtagctgttgaagctatttcctttgactctgatcagacattatgctgcatttcttccaaagtagatcgctaatattgttttttaagggtttttttgttttgttgttttttaacctactaaattgcatttctgaaaataacttat

SEQ ID NO: 1303 - DNA, 172 bp, Homo sapiens
cccattttataatggagaactattaaatttatttgtaaaaacaagaacccttatttaatagattttatagactttacgctattgtgcttcgtgaacctgggcataaatcagaatcttccagagacgtaaacagtatcatgtgtattttttgtctgttcgtttgtttttaggg

SEQ ID NO: 1304 - DNA, 1411 bp, Homo sapiens
gtttttgtttttgttttttgtttaaagcaaatcacctttgctcatcttccagtaaagcaagtccagtcaactctgctatccacatgaccgggaaaactgtctgttgagagttgagactgctcaatatcacacgaattttgcatcaccaaaaaattgtgaaaatatgccatatttggctgctaatctatatgctaaaattatatacaacttatatggtaacccttgtctaagagttatcttcaaatcctatgggaattaacatacttttcaagaaattcttgcctagtacataaacttttcatcataatttctataaattgtgttataatttccaataattttttcaagaacaaaatgtgagtttgtgaaaacttagatggacccaagatgattatgaacatcaacacctgagtagtttcattacatgtctgttaaatctaatctctgaggaagaagtaacaggttaaagcataattcaatgagtgacaaaaatatggcttaccttgagttatgttttgtaaatgactgcctatcgacattaacaattttaccaagataaataaatatataggagggggacaatacacggacaataaatatactgtgtttccatttctcaaggtaacactgatgacaacccccccaactattgttatttgggagcccatcaggtgtcaaagtgctgtatgtgctgacagattttaaggacagtaagcaattatttctgtgatgtgatttaaacatagcaagcaggccaggatgcctttccaaactctttacttgtgtgattgatgcccaacattccagaaagcttaatccctcaaatcagaggttctaatcagggtatccttcagtgttttaaaatactgtatcttaaaaggcagctatccaagcctcaccccagaacaactgaatcagtatatttgcaggttggataaagtatgtgtgaaaagtttgatctctgtgaaataccaatcccactccccatcccattcacactcttaatagagctctccattaaagccattttcgagcatttgcattttagtatgaattatgtagcagatttgggcggggggaaggaaaatgagatgagtccatcaatataatagtataaagactcaggtacaaattgcagaaaatggtgaacttattcttgtatattaagtctagaagaaatatataagaaaataaaatcttacaggacttagagtgaacaatcccccagctcaattatttttacaaagaagctgtaaaatagtacatttctgtaattgtttgaaagacttgcaaaaatttgcaaactggagaaaaaatgaaatttaagttgacaaattacaaaaaaacccttatctacaaataaatagcaacaatacagagatgaataatattttgcagtgcttatgagcac

SEQ ID NO: 1305 - DNA, 464 bp, Homo sapiens
gagaataatcagaatctgatcctttaagatataatttccatcttcgcattctaacaattaaaatatataaacagtctttttcaccagaaaaacaatcttttggggtccttcatcaaatcctaagggatcatctcattagttgtttcttagctaagttccaaactgttgttggtagcatgaagaacatctgaattaataccaaaagtctttgatattacagtaggctgcagattccttcagtaccccttcaagtcatctctattctattgtgtccgtgtcattaggacatagggaaaatctgttcaactataatcaccttgtcttccaaataaagacaatggtagcctccaatcttggatttccaaatttatcttgggaatttcactatctacaatctataggtgggagatgtgaaagcaaagtcaacacaataatggctgactctttttctgctttagcttcta

SEQ ID NO: 1306 - DNA, 89 bp, Homo sapiens
aaaaacaaaaaaacaaaaaaaaaacaggcagactgcaactcagaagaagggactcactagaacccaacccatgttgacatgattctttc

SEQ ID NO: 1307 - DNA, 1145 bp, Homo sapiens
aatttacagaatctatctgtgtttgctgatgtctctgctcagggtttctattcttacacttatttttcagcctggtgtcctaggtgttgcatctcgtatctgcctagctaagaggtcagctaattatttgagcagaggttttgttcaaacacctggagcatgttaggcttccagccctctcaatccatctgtaagtactttgaaaaacatattcaaagttgcagcttgttctcaagtctccataggacttttttcctttttatatttctgtgtctgtttgatctgtcctgcacatttaaagtttcccagtgaagcaacagttgtagagagcttatctcagcacttctatggctcccttgtttccagactctgcctgtgaaatgtctggctagaaggttttccctgctcattcacaattcagtccaccactactttcaattagcaaagctggaatttttgtctcctaccctgattgagtcagtctgtcccctttaagagtagagccactggtttttgcatccagccacaacttgtaagactagggttcctgttatccaagcagggacaactgggaatgtgaacagtcccaaagagatggccagagattcctgctttccacttgcattttccaatttttaagaagtcagactagaagttgttattctcagtccatggatattcaagttagccaagcaaaagagaacactagtacatcaaacttagaaccttggtttattcgtttttatgttattactgttccttgcaataaaaatgcttccttctctcagatagggaaaaaaaatatttcccatgtatatatgtggtacactaccgcattagataagcacattttaatttactaattatacagagtcactccaaagtaactaaagtactttaaggctaatttgtttaagtaaaaataagtatgcaagtatattgggcataaggaaataatttctgaaagaaattcaagttcatgatggagtagaaactttaaacagacatatctaataaaactgaagcattgctcagaaaatgtataaatgtaataaataaagaatttaacttgagagttaattaaaaaattaacaatcctttagaaaataaattgagttaataaacataaaaacagatttttatcg

SEQ ID NO: 1308 - DNA, 507 bp, Homo sapiens
gtaagaattttttgcttttaaatataacaaaatagattaatcattaaaagttaaccaagaaaaagagtagaagtgcaaatacaaaatattgaaatgtttctgtggaaataactacaatcagaaattaccagaattatgagtagatattttgctcaactctgctcaatgacaatgagaacttgtataaaataggttattttctgggaacatgaaaattaattccagaaacagtcaaaaatattactaacattgataatccaaaaaatgtcactataaaattattattcctgaaaatccaaggttcaaactctttctcaaggttttctaccaaacctgaaaggaaaagataactacaatgaaatctatgcagtttaaaaatacagggaaaaaactgaaagaactcaagcactctttagaaaatgattataatatggatctagaacccaaaagcaatagcaggaacaaaagctaagtagaaatcagtcttatttcatgattatgaatgtg

SEQ ID NO: 1309 - DNA, 53 bp, Homo sapiens
aattgtaaatattgtcaataacatggaaataagttgacatttcagttatgtaa

SEQ ID NO: 1310 - DNA, 241 bp, Homo sapiens
acagaaatacttaaatgcccccgaaggatgcaaaaagagatttgaaaaattgtgaaggcacaacttgttattgaagcttcacatcataacatgtaaataggaagacttcacatcataggatgttaattctatttagtcaacttacaaattgtttagaattacaacaaaaaaatcacaaaaataatttatttttgaaacaaaacacactgaccctaagtttcattaaaagcattattaagag

SEQ ID NO: 1311 - DNA, 106 bp, Homo sapiens
cctgcctgatcccttgtctcatagagaagcaaatgcttcaagcagaaaaataaagctggtcagccctagggcataataaaagatcctttgaaggattccttcagca

SEQ ID NO: 1312 - DNA, 130 bp, Homo sapiens
tgtataaataacatccacatcctactgatattagtaaaagagaaaatataatcatgtagctcaatagtaagacacacagcatagacataaaataaaaactgtgctccaaatacaaacaataaaattagta

SEQ ID NO: 1313 - DNA, 202 bp, Homo sapiens
tcagcataaagtgaaatattaatagatatgagtatctaagaattgaagatatttgctttacaaagaagatttgagagaaatattaagggagaatattgcaagaaaaaatacaaggcagtgttatctaggacatgaatatttttcaaatttggaaatcatttgtatttcaagttaaaacaatgtacaaaatatgtgaatagga

SEQ ID NO: 1314 - DNA, 1317 bp, Homo sapiens
aaagataactagatatctgtcagacagcagtgggaggcaagattaacattgtactgcatattgtttcttttaaattttgtgctttgcttgcccaaccaatcaaacacataaataaaatgtgttgttaaagaaaacttacaccaataaaataattgtctacttgaaatcagcaatgagtttattctaggctaagttactggcaggactaaaaaatataaatacttaaaaagtatagaaaatgcccatgctttatttcaaatttattgtgtgttcaaatacagcccatctttatctatgcctgcaactctacgttttatagtatttactatattacaattcttcaaagaaaacttcgcctatcatgagtcacaatttcatttagaattcaaaataattagtaggatagtaatcattcattttaagatatacaccagcattttcaattttaaatagccaaggatctctagatgctaaggggctcaatttcatgcagatattcactttaatctcaaaagccattcacttaaattgtccctgatatgtcattactcattgctctctgtaacactctcagatttccatcaacttgcactcaaaaagctccaagtcattaaattggagaaaatttctttcttaagtctctctattcaactcacttcactggtaggggccatttctatcttgggactagcttacaaaaacttcatgttagtcagtatttctagagcagaatctataattagtggagccatcaaagattgcctttactcaggatttggacgttgacttattttgatcataccatcatcaaaataagtgattaccctattttactcttaaagaagtgtacaagaataagaaaagaaaaattgagatcaatcctaaaggagatttatactttcctagatttggttatcagattattaaaatgattagaaagataaactaaaatttagcttaaaaaataaagttttttaacccttagtatgttaacaaagatatcagcatatttctttgcttaataattgaaatggcaattgctaacacagataatacctagattataatgagattgttatgctatttacaaaatttggagagaagctcaataccattaactttggtaatattttcaaaaggaaatatgtttaagaagataagttggaaacccaatgttatttctaattttcacataataaaagcaataaaaattaaaacaaaacagacaacctggaataaatcatattgcattttcttccacatagacagaaaatgacgtgagctattgtattgtttgatttgtaactgtgtaatcaa

SEQ ID NO: 1315 - DNA, 57 bp, Homo sapiens
taatctacttgataggtttatctacttgattaatctattgacagatcttgtgaggag

SEQ ID NO: 1316 - DNA, 1832 bp, Homo sapiens
agagcaaaattatttcaaaactccaaatcttatcagcagtgtgccatctgtgactgagatgcccttgattcatgggagcaaaagcacccatctgatattctgacattgtttgttttatattttattcttatgcattaatcttcctctcctttccgatatacatcagttataagtggtgggtgaataaatttattttttcatttaacaatttattttctgatctattgtgaagatttcataaagaacaccatatggttagagcaaatattctacagaatttcagttctgttattaaaatattatatcatgaagagtaaatgtatgataaaaataactgaagggatataatcaaggttcccatgtcacagttaagatgttttgtcttgctacatataaagcttctgtttctcctgtgagtccagaaaataataaacccttcttagatgagcagaaagataatggagagacattgtggtgaaataatggttacattagtataagaatgaaaataaatactataatcataatgaactatgctggtgcatcacagcttgtcatcaacagagtctaaatcggactataaggtgagagaaaaatggcaaagaggtgttgaaggcaagagatctgaactggtgccaggatggccagatgggcacaggccttcctgggtctcaggttctaccaattccactcctcctactggccaaagggaagataccagggctctcataggaatgtgctttatcttcatcaatgtgcctgaaaagggagattatcatcactatttctaattcaatatcttcttccttctgccacatccggtgctgtgattcttcttaggtattcacggccagccattgtaggtattgatcagacatgaacactgcaatcatgttactaaaaattggctgtagagaagaaaggggtatcaaaattggggtactgaggattcttataaaagctgtcctctctgccagggagcaagtttccctcctctcttctgaacatagtttcccattgtccatgcatgtctgtttgctagaaacaagagaaaacatttcctctctcctggcataacaggaaactatatgtaggaaaaaataaaatctattgtccatggaaaaaatgttaacaacaacaaaggtttgacgtctccccagaaaaccattttgtgtgtgtgtgtgtgtgtgtgtgtgtttctccaggaacaggggtgggaactggatattgaactatattcatacccacatattatatcctcagatgtcattcagaacttacagggagaacatttttttaaaaaaacacccaatattcagagttctttacagacaccacatgcattattacaaaatacatttggtatatcgttactttcataaagactagatttttaagtagttctgtgcaaccgtgtagaatatataaccaagaccactatgcatcagcctcatctactggtttaaccctgaaggagcatcttcctttgttcactgcagtcttagctgtgcaggtccaaagaggagaagatggttctgcgtgaaaataatgcaaacgaaactatcaagcaaactatttcctcagcatccagtctgtacagcaccctgttttttctctgtattgctttatgttattacattgtgccctaaacctttctacatagatatgacaccaatacctgaaactcaatagatttacaaccaaaccattaatatttctccctaatatataccttccgtttcctagttcagataatgatagcaatgtctttctagcatcttcactttcttcctcttcttcattctccaaattcagatgatggtcatcttttt

SEQ ID NO: 1317 - DNA, 248 bp, Homo sapiens
taaatctcagatttgatcatattaattcctggtttggaagctctcacagattccttattgcttaaaacaccatttccttggaaagttaggtttggtttgtgctaagaggtttgaaacagttgggaaagaaggaaggccagaacatataggaaagtacaaaaatatttcaaaatgtacaaaaatatttttacatcatttggctttgcagggttttttaatggacttattgtacaaaacaatactattta

SEQ ID NO: 1318 - DNA, 99 bp, Homo sapiens
aaaccattttattttcctttgcagaacatctatcacttgctgctgaggacaaactagaagcctttatcctcaattctaatttctaatctctatttctat

SEQ ID NO: 1319 - DNA, 242 bp, Homo sapiens
tctaatctctatttctaatcactgatgaacttgaacccctgtgagtttggtagtaattctggaacaagaaagattggcagtgcttgagtaaagttctttatcttttgaccacaggtttgtggcatttgtctagcaagtggttattttttgcatattttctttttggtggatatgttgcagatagttaattgttactgtaagctgttttcagatttatagtctggtttctcatgtatgaaatg

SEQ ID NO: 1320 - DNA, 1133 bp, Homo sapiens
ttccaaaaaaaaatcccttccatattttactttctcaatcttctttttaatgcagaggaaatttagttttctcatccacagcatatctatatcatgaggggaaaaatgttatttgttcatgactgaggtgaagtaagctctgttgttatacttgttcctttctatataattttaatttcttaattgagcctagaattgaaagaagcatattataactaggactctaaaaatagtaactcatgcctaagattgcttgcattcttacaagtaaaagaaaattgttgaaataattgactggttgccagtcaaatgcttttaattttttataatttctcagcactggccggcatggtcattgttacacaggtttgctgaagtgaaaatatggcatttgctaagaaaaaaaaaagaattcagtatcaggagtgatgtacagaatagataatttatacaatctttccaatggtaatcagcatttgttttgtaaattgttgagtaaataatataaaagaatgaataattcagaaactaatacaattagttatacacaaggaataaaatggagattagatcaaagtgtgagctttgtatttccttgtccttttcttttcctgggagaacctgaaaaggactgaacacaaacgcagctgagaagtgcccatgggacaagaatgtgatggacactcggtcttattgggattcacaggatcttagggtttagatgacagaagcttacagaacacatcccaataactgcaggtctcccaggaaaatcaacagatcagcgttttatttcccttttcaccagttactcttacaggtcctgagatcctgtgccatatctagagaggttacctcagaaaaaaattaagacattttatatttaattcatttattcaatacccatgtattagtacttattatacttaatactatatacttaagtgtttgtggttctatgaatcatcagacagatttatcttctcaggaaacttaatgattataagaaacattttacacattaatcatgatttgtttaaataaaaagaagataatctgtagtaattaaaattttgaaatatagtatttttagagtgaaaaggatatgtataaatgagaaaatgccaagaaca

SEQ ID NO: 1321 - DNA, 724 bp, Homo sapiens
aagaacacaatttttttaacaaataatttgtattgttcttggagacttttgatgaatagtctcaaaaaatatattgacaatcctgctttcttctaaaccatgttcttagcattttcacatatattgtaatttaccttgtcaatctacaaaagcttccatgttaaaaactgaagatgtatttccaaggaactgtgggatcagtatcttagaatactgttctttcacagaaaatatttttattttctgtaatgacatccagccaacttcaagtttttaggattcagaactgtagctggtgttgacaacattgttaatcttcctacacgaatattcaagggaaaattactaaggtaaactatgaaaaatttagcatcatttaaaaaaattacttttactcaagtaacattgtcactgtctaaatgccaaagtcttctttgtaaaagtcctataatttgttaaccactaagcagtttttgctttctaaaatattctgtacatgtctttgaaagagaagatagcattatttttaaagtattgcttaatgaaatcatgttttgctataataacttattttggattcaagtataagttataattgatagtattacataaaaccagtgttatatattagaacaaactctacatcaaaagtggaaatcatttttttgtgtcagttaaaactcatcaatttttaaaaattgttttagggagactaccctcattc

SEQ ID NO: 1322 - DNA, 540 bp, Homo sapiens
tatctaaattagagaacattcagaaaatacaattctgttattttagtacatgtattatcttgataaaattggaaaagtactgttaaataataaccatcgaagttgctttaaatgtgtaagattcacttataatcaatatactcattgaataaaaattattctattgaaatctaaaaattatgtaattttatccttaaaaaaattaagcattttctaagacagcaaagtattaatttgttacctacactcttttcccaaaatcattaaataattattaatttaatgaagccatatttaacacaaaatttcattgagtttgtagtctatattactggagatctatgggaaaaaaatttctaaattcctatttaaatattaaattattcatgtgcttattctctaaagttaattttacagcattgcaattagaatactattaccaaaaacattaggaagccaccatattcttggataaaattctaaatacatatcctagtcattacagatattaaaaaccttttaagaaaaataagcaatgtg

SEQ ID NO: 1323 - DNA, 471 bp, Homo sapiens
tataaataactagtgtgaattaaataagttaatattttaaaatacttgatttaaatactttggttatgctttatgaataataatgttatgccaacttagcttcatctaaattttactataaaaaggaacgaaaaattaatttcatgccaagaaattattagaaaaagaggagcatcttggccacatatgatgttgaaaggatctttgtctatttgaaattctggactgaataaatgtcagatcaggaatggtcacttcggagacaggccgtgacagctgttcaatgctgtcacataactgcataagaggaagcagaggaatttgcaaagagttagtgagatagataaagcaaaaattgaaagcacatcagtaaccaaacgaaagaaacaaaaactaaaagaacaaaactggacactgaattttaaggggaaaaaaattatacagttttcacacacacaaaaaaaaaatggg

SEQ ID NO: 1324 - DNA, 287 bp, Homo sapiens
ggaaggtaaaaaactataaacaaacaaaacccttttgaaaaaaaatgggtcatgaagagatttatttcattcaaagtttgcttcctcaaagactacaaatcattcgcaaacacttaactcatggatagtttccatagtgacacagaaaacccaaaatggaaacagtttttataggttcttaacccatataacagacaaaactgtctagaacagtggttacaattcagactatagatgactacaagcaattctataagaaaagtgattgataaggaaatgataactca

SEQ ID NO: 1325 - DNA, 834 bp, Homo sapiens
aggaaggcaggaagcctggctcacaatattctaaagcagtagaccacacatagtcacatattgaagcaatcatgaattgctatacaaagtaatacttctatatttcttaaagtgtagactgtattgaggaaaattgttgattccaccctcttcccctaacaggtttaatatgacccgctgtggttgaaaaacatcaacataagctgttgctacgctatttatgtacacatctctaaaaaacagtttatgaaaataaatgtatatgtaaacttttttatttacatgtttgtctatacacacaaggaataaaaagtattattacagggcaatgatgaaatgctatttgtctctagttgctcttaacccttattaaataatcactactgctctttatacttcccttctctttcatttagcggagagaaaattgctgggctattttgtgccaccaacatagcccttccgaactgagagacttgctataattatgctgcctcatctttagatttctccagcctgtgtctcctttctatactggaaagcaaaggcagaactccaagattggattctttgagttgacccactgcacagttctccctactttccatcccacctctaacacccctgcgtgagttaagaagactacaattctgatatttccttacaggagtcccagttacaccatctatgagcagataggattttgtagattatttcactctttcattagccactgaaaatgaaaaactccaagggttagaattatgaaatagcctacattttccctgttattattctaaagcgtccaatgtaatcaggaatctccttattatg

SEQ ID NO: 1326 - DNA, 191 bp, Homo sapiens
acagtgagtttaatcctattgttacttattacatgctaaatgttaggtttcttaatgtaaaagctgatcaatcatatgtgacactttaatagagtttgttgaaagcagagacgttctgatcatctgtttagcaatacacttcttcatccaaaaggtatttactaggttgattttttaaatccagaaaccat

SEQ ID NO: 1327 - DNA, 1157 bp, Homo sapiens
tttggtaaagtgtctcacttggcatggagggtcacttagagatgtaatatcgagtgatctgaatgtgtctggacaccatgacctgcctaactaggaaaattatgtcataaaagaatatttatttattaaagtgtgtatttctgaagccaccgtgacaatctattagaatctcctgttggtagtcagggataactagcacatcctaaaacaatgacatcaataaaaagcacttaaagagctgacattagaaacaaaactcatgttccccttgagaatgtcatattgcagcttaagcccataccctgggctgccttggcttagtaacagcatcttgctttgacagccttttgttctccctagctgatattctggcggcggatatcagcacatcagttaatgtgctttccctcctgtaggaactgatttgactacagttatgttacctcatattttctccctcattaaagtgcctatttgcaatttgttcgaaggaggttgccagcctgcaaccactgttggagcgtggtgcccttttactggtgattaatttacacaactatacagggttcattgtctagctggatttagttttcatatcaatctgaattacactaaaatagatatcaaggaatgctgccccattcatcaggagagttatagcttttattgagcacatagcatttatataggatttttatttaggaagctaagtggtgaatattgccttgactatgtagctgacttcatttcgtggaggtagatacatggtttcaagttccaaccctttgctgccactgagcttttcttgtgctcatcatacctatatgtaccttcttcattaggaggatatgaaatgtcagaagtagtcagtttctgctctaggcagcatttgtgggtgagatccctggtcaaaccaatgcatagatttagttttggagacaatagttaatgtcacttatttctgaggagctgcttttccatgatgacagacggccatcccttagctttgttccagaatctgtatgtgtgactttggagctgatcattttcatgattttgatagaagctagaatttgggattctgctttaatggtgaagagaaggttattttagtatgcctggatctccctctgagatattttaacctaccatttgca

SEQ ID NO: 1328 - DNA, 410 bp, Homo sapiens
agttcacattaatctttccatgtttgaggatcattaagtaccaggcacaggggaaatgattagtaaatagtttctacaaaactgagggggaggggaatggggagggattagaggtatttgcttttgtcatgttgtgatttggttatttcattgtgtaatgttgtgatttgtcaacagaggttttatgccagtgttatgactttacacaaagccttagtagaggtggagctcctgaaggaatacaaagatgtaacctatgacttcagatagtggggtttacagagtgaaatattgttcaattcaaacagaggaggacagagaaagaagtcctggaccatgcctctcaaaatcttttggctgacagtgcttagtggtaacacagaggaggcactgtattcattcacacaatc

SEQ ID NO: 1329 - DNA, 721 bp, Homo sapiens
ccttcattaggaggatatgaaatgtcagatgctgaaaggtctctgcccatctgtgcacagaccatggaattaaaggaccattttggggagggttcaggagaggtaggtgagtagaaggtagaatgcaggtgctggaagaaatgttcaatcaaagacaaaggcccttaacatgccagcagcttgaggggccctagattttcctgctgggcaaattggagttctggatctttgaaaggtacggaagaactttcctttttgatgcctttcccttctttgttaccaaatcaggtttatttttagtgcctgccttatctgagcagtaggcctggaatgattttataacctacctatttattttcctttaacctgtagcctgcttgtgtgtgtctgtatagctgaaagagactttgaagtaggtaagatacgaggttgggcttagaggaaagattaggttttggggtaagtggaacaagggtgtatggggtgggaaagggaatcaaaacaaaggcagagaaggtaaaaataactttcatatgtggggctgcttcctatgtcgttgaattagaaaaaataaaatggcaatgtatttagcatagtagtgaaaactccagcaggtggtatagcaacaagggaaacctgagcttcattgactccttgcatctcacctacttctaaaaaagactcaagtcatctacatgtagacagcacagtgtgtagaact

SEQ ID NO: 1330 - DNA, 507 bp, Homo sapiens
aaacagacaaaaacagctgtaatataataacagaccagaggaaagaggattaattctgtctaattccatttcaccaggatgtagaagtttgaaaagttgtctatgaggaagagaggaggaggtagcgaggcatcccttgctggggagggcagggtcacagtgggagcagagtgcagggcaggtccctggggagcacagagctgggaagggcaaggaagaagtgttaagtgcagagtctggaaagggaaactgagcccaagcgggacttgacttttatagaaagtatggatccatatgttgttacacagagaaatacttgctctttattttagaaagaaaatctgtaaatgtgcatcatatcactctgtctttttctctgtttatttttagccctgtgtgtccaaatgctgggagaacatcaccccttggatgaattgccaccacattaaataaaacatatccaaagctcatattgtttcctttccagtactttctctctgtctttcc

SEQ ID NO: 1331 - DNA, 550 bp, Homo sapiens
aaacgtgtctatattttgtttcaaacaaatatgcatgtacatgtgtatgctcttatctctcaaaatcttaaagaagtgtaagattatataaacttactagattcttcatggtgttgcatgtgctagagcaaatcttcctcaatgcttgtatatttaatagcctgaaagaataaatgtttttctaatgggcatattttagctgaggtttttttttaagtcaaatatgtatataagtatgtgtaaagtttatgtgaaagaaacgagagccttgttttcagaagctcttctgtgtcttgaaggtgacatgtttttgctttcttaagtgactttacagacgaaaaaggagtcacacttttacagttgatttggtgtaaccctccttcatcagtatctagcatatagagtatgctgatgagtcatgtgcaatgtgttttgaaaatcagaagttttcagatgagctggaggcctggatgcctgaaatggcttaggacataaactgctcaaaaataattataatacccttttttttgtaatttttttctactttttt

SEQ ID NO: 1332 - DNA, 928 bp, Homo sapiens
taatttcaatactcctaaagaaaatccagtttcctttgtaaaatgttccttatgtaacaaaactgtactgaaaaaatgtggtatttttctttctctttattttgtctccctataccactgagaagttaatggtttaaggaaaatatttcaagccgtacagatcatgtcaaatatttggtttggtaggattaatattttactgcagagtgacagtgctagtgctgtcctagttttagggatgattatataaactaatgagccccatccattaaaaaacttagggaaacaaaaagctatttattatgtggattacactgactgtagttaggattacactgactatagttaggacatggaagtgtgaaatagttacaacgtggttgcgtttaattaaagttgctctttttgtgatgctgaggttaataattatgacgctgtgcaaatgtttaatactgctttattttaaaaaaaactcaatgttttgttgttttgtgcctagctctccactggcctaaagctgacttttcacttaagtttaccatcctctgaattatttccattacaacagattttaagaatgacagttggctgggggcattgtaattgtatacttcagccactagagggaagagactctagtatttattctggggaaagaaaacgtgcttcatctctctgattctgtcactgacctttaatctgaagggggttatccttagcattgggattacccttcttcctcttttagagaaaaaactttgggaaggaaaaggtagaattaaggatattggaccagggcttgatatatgggtgtatctgcctgaaatttggggttcaaccagttccttcaagacagcttccaatgggcaagcagctttgttgggggaagtgagtgattcttccagaactattttatctgttagtataa

SEQ ID NO: 1333 - DNA, 227 bp, Homo sapiens
ttccacttatgcccagtttctcaagcacgaagagacattcacagaattttgacaagtttgagtctacaaagatgagagatattttggttgaaaactacaacaggaaaactgtagaatcaaaatttataccataatttacccaggaacacatacatggttcacattttaacgtttctagaatcagattgtggcttacagctttattcagggaaataagacatatttgt

SEQ ID NO: 1334 - DNA, 28 bp, Homo sapiens
tttgaagtgaaaatataaaatacttata

SEQ ID NO: 1335 - DNA, 859 bp, Homo sapiens
gatcctgcctcttctctaggattcacagaagcatttttcaaaccgcacctgcccctccttatacctccttgctcataatcaggtttaggctccttactttcccttcaggaagtcagttattctcatcaaggcttcagaaatagtcctagtgttgagcacgtgggagagctgcttgtcttcagagtggtttgacccagtcattgatgagttgaagttttcactgtctcactgaggcatgtggcagctcagaattcattcaagcaaactgggcagagtctgtggtattcaggaatggaggcacagcaggaatgcaggtctgtggctttgatcaaaacccctatccacaaacaagcagagccctgtgaatatggtgaagcataattttttccccactgacattttgaaaccagctcccttacagaaagaaatatagttttggacaaacttcagggagtttccaagaattttcaataaacaacacagtcacactaagcaaaattttttttcaatccaagaagaataaaacatttttctagaatatataaaatatggtagttttatttagtaaaaatataaaggaactttaaaactatcttaaatctctgttttaaaggatttttatttcatctcattctttaaattttaaaatttgtaatcaatggcagaatattcagagaccagacacataaataaatgagctgagaaatgtgcttttgtagctttattcttgatctccaccttagggcatttctgtgctctccggcaagccctcacaggtttcacagggagacacagaggattgagacttagaatttgccagctgttgacagatctatggaagagtcagtgtggtaagaag

SEQ ID NO: 1336 - DNA, 97 bp, Homo sapiens
gaattatcgatggatttctattattcatgcttgttttcttttaaagacctctttaaaaatgtatatggccttagaaactattgattttgtttggaaa

SEQ ID NO: 1337 - DNA, 28 bp, Homo sapiens
ctataataaacctcagaaatatagtcta

SEQ ID NO: 1338 - DNA, 2692 bp, Homo sapiens
cccatcacaaaaaagctatgtattaagttagtttatattcaaatttaaagagtcatatgagcattctgtattacttgtctcagttgttgataaacttacctggtcatgtttctctatgagactttttcttaagttacttgacttgtaagcttataggtgtaaatatgttctagagtttcctggaatctgacagatagagtacatgtgatttctttggggaaacagatatagttttatttattggactatttcttagagaaatagttatgaatttagttattccctatgaaaggctgattctttggattaaaaaaataggttcagaattatttgagtgaaagcttctcaaaaataatgactctgaaatttaggaccttaaattgctaccacactcaaagaagaaattctgtcctaaactgctctgaagtatcagtggtttgagagaagggatgttacagagactacaggcatgaaacagtctgctgatactttgccattagaaaaactggctggctggtttgcatattctggtctattcatttgttcactgtttcccacttgttctttcatttgcttcccttggagagtagcaagttgaaaaaaattcagtagttttggtatggctcatatttacgaaatgccaaaaaagaaccaagagttctttttcctttctcctcgaaaattgcccttgtttggatacttacatgttatatgatgggcataacccctgggtcccatgttgatagatgagtgttagactcacccagaatattacctgtcttatatctttgaagcacatacgaaatagcctttgtgatttgagtgactgggccagtgttctccattatgtgcagcaggcttcactccacaataaagctgaaagaacttcactccccagtaaagctgaaagtaacagacaatacctcaagttttaggtgctttacagatacctggcagctcactgaagtatatccaatcctgtttctgggacaaaatcactggatggatctttccgagccatgatttttgcagtaatgtttctgaagctatagcactagatacaaaggataaatagaaaaatgattattttgaaaggggagagaaaggactctggcagtatctgatgccactctagatgttaaatgtggttatgtttatcttttagccccaggcagtttatggtttaggatttttgaacgattgaaggatgtgcctccatgagccctcaccagagacagcctgggccttcctgcttttttctgtgtgttttgcatcaagcagtgttatttgaaggtagctgcagttccttcagggaagatgagttggcagcaaggcagacagatacagtcatggagcaagttactaaagacttgtaaatcactctcaagttatataatgtgatttaatatatattaaaacaatgatagcagaaataaataactcatgtaggatgaactgttttcagttttccatgatgcctgcaaatctttttctgtatgcatgcgtgattttatgattgcaatcgtaatacaggtgcacttttttctgttgttttttcatgtaatgcattaccatgctgctatataatcttcataatgatcatttttggtgtctgcataattagtaaataagtcatctactcttgataactatgaggaaaataaaagagatagtgtctatatcaagaactgatgtccttttcagtgtttcgcatcttcacttccggttttctctaatgaaaagaattagggagatggagtgatagctaccactccttgggaagcctgtctctaaattctgatgggtagcatcatctactaaactcagacttccgaagtcatgggcagactttccccatcacctataccttgcactttcatcttaaagtttcagtcccctttaaactgtaaagccagctagatggtcacatcttctaagttatcaactaaacgttaattcttacttatcaatctcatctaaagccttaggtgagattgattgtctgtgcaatacaggcaagaacaagatgtaggaacgggcagttgtgaaagaggaagaaatgtgctaggagaggagatgaacagagggaactgattgtgaaacattactcagatgagctgatctgaagtctgttcaactttgtaactcctcctaagtgcgacggaaggtttcactgggtaagctgacatttgtgagccaggagccccagactgtgaggtggtggccagcagattgcaaaccttgagcactgttgatgtagcactcttgattctcatcttttctctgctatggctgtgtgtgttgatcatgtttccagcaggattgagttactaccttggaaaaaggtcaccctgctcaagttcatgtttttattcatctttttagagaagacaaactacactttacttcagccatacttattgggaaggaaagtaaaaacccaatagtggcgtttggttcatttattaataaaccttttaaatatgcctgaatatcatggactttttattgatcattttattactcattacgaagattgtcaataatgacagtgctttaaaagaaaaatcatccagccaattgacaaaggcaacctgattttggaagcatccctcagggcttatctgtagaagttggaaaaatagaaaaataactgtttttgtttttagttaaccttagaaaaatgtgtgtg

SEQ ID NO: 1339 - DNA, 35 bp, Homo sapiens
atattccattaaaagaggttttgatatttttgtgg

SEQ ID NO: 1340 - DNA, 1387 bp, Homo sapiens
ctgtagaacaatggggacccattcaactttgtttcatgggagagtgatatgactgcgtgcacctgtttgagctgagcagttttggaagaatggtttcacattgacagtgaggagcaccaagaggaaggaacggtaccgcattaatctacacaagagatcgtggaagccatgaccagggtcatggcaagtgaggagaagacatgaaaatctattgttcctttatcattttatacagagtgaaaacttttacccaattttcttttattttccaattttccaatctggtgtatttttcagccacttttaaatgggatttgcttttcttttcagttttctattgctgctgtttacatgtcctctggccttgtttttctttctccttcgtatattagcattcttaataattctgtacgtacttcatttcctaaaagctacttataaagacaattcttgtttcacattcattcatttgtcactcacctgtcactatattgagtaacttgactggctgttgttctcattcctattaactggagtaacttctctttgaaagttttttgatcaccaggaactttaatatggttgtcttctataacatgtatgacagtacattgaatacaagaatatttctatggttggcagcagaaacgtcgtctttacctttcagtactctcagtctaactatatacagacagtttaaactgaattacctagtctcatgggaaataacaagttagggtgttttggagaaaggaggaagtaatcccaaattatagctatttaattctttgaaatgaagagcattatttttattatattcatgtctagataatgttaaaagtaagtttgcttctcaagagttcatgttttttttgagcagtgaaagaaagctttttcattgtacaacatgacagagggaagcaggtctggaattcaaaactgttcacataaatgcacagcctcaccaatctgcaaataatgacacatatattcaaacaaaagcaaagcactgcatggatttaaagcccagtcggctttgaaaatacccgtttgcccagttgccatagacaaggtagtaaggatttatatctagaaatcagagatatttttcatttttatattatagaattcctgagagtaggaaagacttctttttaaaagcaattttagtatttatttccaagactcatagagcttttattaatgcatatgcattatttcgtgtgtcaaaaaatatcaatcaaattttattaaaataccagagtaaaagtgtgtattgttttcttaagtttgtaaactcttcaaagtattctaaaattctcaggaacttgaactttcaggtcatgataataggactgtcaaatgtgtggctcctggaaatcagaaa

SEQ ID NO: 1341 - DNA, 36 bp, Homo sapiens
acgaaaattttttaaatttaaaacaacctaggcata

SEQ ID NO: 1342 - DNA, 82 bp, Homo sapiens
aacttgtaaaaaaacatgagaagtataaaagaggataaatcataattctgtactgacagatgttcattaaaaatactttgtt

SEQ ID NO: 1343 - DNA, 105 bp, Homo sapiens
tatatatatatatactttgttgatttccatcgtttttattcgtatataaccatatatataatatcttaatgtagatcatagaacttcatttttttctgattttaa

SEQ ID NO: 1344 - DNA, 67 bp, Homo sapiens
gtgaccatatatgggtctatgtatgtatatgttttccttctccaaattgccttccagaaagttagta

SEQ ID NO: 1345 - DNA, 958 bp, Homo sapiens
cttgtcatgcctgacattatatttatacccctatgaattaacgtttcttttaaactttttgttggtatagaagtgatataacttaatagaactccttgactaaataacttcatgtcctccctgacatatcttccgatgtgtggaataattggaattgatcttagcaatggaaggaaattccgattgttacagaagcatgtgatttctacctctgtatatgctccctgtttggtactttgatgaaaactcatacttctcattttaatggcataattttccataactttagatgtatgacctggaaaaaatattcaagaaaagaagaacggataaattaaccttaatcttaaattacagaaaggtcttagtgtcagctacgaaagggctaaatataaccatgctgacccacttaaaccaaattgacacttcttataattgcactataattcatgctcaagagctgtataagaaatgatgcaccttagacccaagtttctggatcaagaagcaccttgtccttgaagttaattccagattgagcatctaatgcaatgattagtagccatggttcactgttaccatcaaaaagaatttagcacttcatacacaactagttgtatatttatacttaaacgcaattcgttacctatcatggtctctgttgagattttgaaatttgaaacagtagacctgcctaataggtacagcttatatagataatggaatggactcatggacccatgaaactgaaattgaaatagacaggaaaaggtttttaaaacacatatagggtcagtctttaaaatattaggcaggtagccctaactttgttatcacacatctttctaacctgtagcaaatccatcctcaatctcttctttcccctgcccaccccttcacccccaatcctttctctattgttccctttctccctttgcttaatattcatcccaatggt

SEQ ID NO: 1346 - DNA, 809 bp, Homo sapiens
gttttctgtttgccgggtgatgcattgatctccaagtgttgctgtctacttcataattggattactggcttgggtggaggccagtgctccacgtggtttattgatggatcttccagacagctgttttagaatggagagatacactcatctctggatcttgcccagtagtctccttcttttgcatgaccccttcatccctgtaaggatgccatgtgttttctggcagtgtgtccagctgttctcccacggggtggaactctgttgggactaagctatggggcttctcccaggaacttcccctgcttgaaagtcagaaggtagagtgctggagtgtgcttgcaagacatgattctgcaccttctccagtcctatgggctgtgtgccatatatgtattctactctaattatcaatcatacatatcaaggagtcactcactgccttgggagataagtgcttcatttcccatatctatgcactgtcttctcttatattttgttagcttataggttatctgctaatcttttccgtgtctctgattctcctgggatccagagaatgcctgagaaagaccttgcattctcttcccattctggccagtctttagcatgtcctttacttgcttcagactgtatcctttacactaccttcggagattgtgtagttctttgctcaacccatcaggaaatagaattcttattttgtttcctttgttttgggttttttttttccttttccttttttgcttccaggataatgtttctttcattttactcattcactttaaaaatctgaacctctcttaccttgt

SEQ ID NO: 1347 - DNA, 664 bp, Homo sapiens
ggtattttccaggatgatacaaccttgcctattatctgtcttagttttcagcattcaggcctatccctacaagttaattgttgtctatctttttatctttctccatattttagcattgtgagtgcaaatttgtttaataatattagaaacgctttcttcaacctgttcctcattgatgtaactttcttcccatttctgtcccagtattaaactttatttcttgggatgtacaaaatgattacaaggattgctcattcaggacagccagtttgctgttcacagttctagcctcaaactctcaagaccacatttagaaggtgaccaaagtggacttgaaggtgtggacagccctagggaactagtcacttctaggtgccctgaaaatggggatgggaagatgtcaaagttagtttagggcaaaatccttagaataggccaggatcaggtagagtgcttaggaaatctcaacttagtgtcttattgggcatggcctcatggcccgagtgtcctgcacagggagctgacagctttgcagacttcacatccacactagaaaactaagtcttttcatagaatctaagttcaagacaagactccaggcatattatcttttaacattgttctacgtggactggagaaaaccccttcttaaagggcatgtgtt

SEQ ID NO: 1348 - DNA, 693 bp, Homo sapiens
gggggggggtggcttgtgtcaacaggtgggcagtagacagaattcaagtcagtaaaaaggacctggcattttttgtatgtagaaggggaggtaatagtgaaggatttgaccctttcttaaatacttatttcttcctaagcttgcatttcagtaggatgacaagcttgttttttagtttcatttaccttacaaaaccaatggctaacaatgtcatcctgattaaatgaatgaaagttctgaaccacaaagcttgtccattgttgtataggcttagttgttacacaatagaaaatcctgctgaatatctctatattgacctagaccagctatagtcttaagaatttccagtaatctcagttccctctttgttctgcagttgagttttactgcagtcgcaactatagtttctgcccatataattattttgtaggaaaatgtcagtagttttgacaattttaattcttgtgtttaccgactgctctgccttctgaatcatatgtaaccaaatcaagtcaaacaggttagaagacaactcacacttcagtgtcatctgtactcttatcttcatgagtgtgggaatgtacaatccactttcgctcactatattaattcattctggttcctcatgtacttaacctatttttattttttcagtttggatacaacccaaatcctctcaagccttttaaatgc

SEQ ID NO: 1349 - DNA, 381 bp, Homo sapiens
tatatgtagttaaaaatactcatgtctttacccattcctttgagaatttctgtagaggctttctcaaaatgcagagagtggaggcagtcataacatatgatgcctgcagattggggtatctgtcatttaatcaagagaagaaataaacattttatgtcattgatttatccattttagttgctatcatctttataggttatgccccaatacatgggcttttctagaaaaactatagagaatatgagagttgggaggtattggagtcctcaggtcttcaaaccacctacaggttgtgttctactcactgtatctccttcaagttttctctgctcaaacagctctcagaaaatccactcttgtgtcagctctttcatctttgga

SEQ ID NO: 1350 - DNA, 293 bp, Homo sapiens
aaagttattctctgggcttgcctttgaggaggggacatgggactcaaagggaattccccttgagtttgattgtgacatttcttagagccatgtaaagacctgaggaatgttagcactgatatctttccagctacatgatatagatacaaataagtcactaagagaaagtcttcagaatttaccgtcttcatgggattctcaaaaattcagtattctttgagaatacagatctactagtactaatagtttcagtgcatcttaagagaaataagagatacttgggcttctgaagt

SEQ ID NO: 1351 - DNA, 124 bp, Homo sapiens
cacagtgtgatcagcagcctggttgaagactctagagagtagaaagaagcacattgtggggtgtcctctgctccagtcttatgtctgtcagcatagtattctcttagcttctgtatactgccta

SEQ ID NO: 1352 - DNA, 206 bp, Homo sapiens
gtatatcagcctcttacaggttggtcctattatggaccccatattgcagctggggaaaatgagaagagatttaaggtcatagtaagtgttgtatccagaattcagacccaaaatttttgctctaaaccagtgctctgtatcacccctctcagagaagcctttatctggagcagtggttcccaaccaggggtgattttacctcccaa

SEQ ID NO: 1353 - DNA, 176 bp, Homo sapiens
tgctccggagcacagggacactcttttgtgtcagccttcaaaacatcttttgcaatacttagaaacattttttaaaagaagagcatggggcaaaaatgctggaccaagctcattaatatctattgaagtgtgttttgtcatttagtgtccctgaatgtttgggataaagtcccaaa

SEQ ID NO: 1354 - DNA, 6085 bp, Homo sapiens
cttggacatgaaacatcatccaaaactcttggagtccttggtgtgaaaatattaatgtgggccacaagaattagataaagaagatcccacagcaggcttctttttgtttaccccgcctaccttgtcagcttacaccccctcttccttctctttatcctcccatttttgtaagcgagtttgttcctggtatttactgcatggactaagccatttttagatgtattttttgctgaatatatacttttttgatttagtatttcttgccatattacaccagacttaaggcagctaatttaaattatattttttctttatgtactttatacaaacattcatggatagggggagatatttaaataccatgcctttcttcaaaatgaataacaagaacattcagcccccttcattctgccctttcaaggtctaacgtacttgaaggggcaatacttgtagcatttgccacataaatgccaggtagtgtctttccacatcggggctcaccattacctagatctgtagttgccggccatgaagccaaacaggtgtgcaccgtggtcattgatggaacagatgtaaactcataaatttagtttactgaggttttcggtgagtgtggcttcccgtccgcgtgcttttcctatacaaccagcggcgtcctggcggaggagtcactgtggacttccccggagcgttgtcactgccatccctcccgcggtgaatcacaggtcggcctcaggtgcgcgcagcacacacccggagcagccgcgggtttatttatttatttccgggacggatccattccgggctccggggagggggagcggcggcccaggctgcggggctgtcccggcaccggctggggtcgcgccgcggccgcctgctccctttcccgtgagcccccgctcctcaggcgcggccggggctggtggggggtgggggatgcaggaaagctgggggcgcggccaccaagctgtccagggacaaggccctgccgcctcctcccagccggaccctggaagggtccacaaaggtgtcaggttcaagtcctccaataggcccattttttaaaagtgcttttaagtttccgcttttttcaggaggggagggcaagagcagctttttctattcaaattcttttccttgtatgtagataccaaaaggaaactcggcactgggcatgttcggatgtgaatggttttgctgataagcaacagcctccggaaccaaagcctcaaaatagtcgtctcccccgcccctcgcagaagcggcgagtggtatctgccaaacagatgacaaagtacctccgactgaatcccacagacagcgctttgagcagaacgcacggctcaactcatgtaattactgtttatagctggccgagcctgactaggagagggcagacccgagaggaaatcagtttcccggacctttgagaggaggctgtgtgttaattaaaggctaggacgggacgggtacttctcagacatgctccaagttgttcttgagatcacagttcccatcacattttctctggagggagtgagtagataattgggattttttttttatttttggccttgtctttcttccttttttttacctctccccattttagtcatatggccttgaacccacagtgaattgaagagagaaagaaatggatatgtctgaccccaatttttggactgtgctctcaaactttactttgcctcatttgaggagtgggaacaggcttcggcgaacacaaaggtaaaaacgcggggatctctgcctggagagggaatgctttcacttcccaggggcccacaggcggagctgcctgagcccctcaggagctggggttttgtgtattgggtgacactttgaaaagtttatgccccgctaggggagggggtactgtttcaggtatttcttcgtccttgtggtttcctgggtaaccctgataaatgtgcttctcataggttttctccttttgaaatgtggataataagacatttccttgtgagaggtgggggagaaaaagggaaagaggaggagatactttgtctaagtctgtccctttgacctgatcatgtttatccatttcattcacccagtcattgaggcttctggtacttttcgttgagcccttcagatgttcctctctattaaatatttgacctttataagatgcagatgtacgatgcaaggatagcccaggttagctatttcatactatctgtggagaggcagatctacataactttgtcattttgatttttcaatggtttgctggcatttattactaatacaggagtgtccttttcattttgtaacgtatatttgatagaaaagatggggaaagaaaaagaattttaatgtcaagatgaagctcatgccacaagtgacaggcagttccaagagtttgctgacacttgtgttgagagactatgactttgaaggaggcatttctcaccacatttgtgtccagcacagaaaagtaagattgttgtacttttagaggggcacaccttttgagttgtgttaatactgattctttgttttccttcaaaacttgccttgcatgtacatgtgaacatgcatgagagcaactttgcagtcagataaacaggatgcaggctctcagatttggagcttcacaatctctatgcttcagtgttcaaagaacccaagaaaatggttcgttctttttggttatacctgtaactttttgtagtataaatgtggatatgtgatactttagaaaacttagtttttccttttgaagtttttcatggtttcttacatttcagaaacatcctggaatactcacatacactgtttatatacatgggtgcacacacaaatcacatgtgcacctgtgtgtatgagagagacatctggcaggtttcaaagtcatatttgctttttgatgcagtttgaagtgttgataccactaaactatgttggattctgaagttgtaccttttaagtaatgtgactatgtttttctcgttctgccatatatggtcagagaccctctcttgtagtattgctcattttgtagtattgctcatcaagttgtgtcaaccatgcaccaaacctccaagacaactaataaagttgaagagagatacatgctacacatgaactaggccactgctcaacatggtgataattcgtatgatttcttaccatttcagctggacagaatcccttaaatatttctgagttgtgtagtcctggctgcggtacagcctctactcttacctggaaccagttcttagggagagaagtctgttctggcatcgtatgtgtgtgtctgaacccgtagagcagttggagcctttcttcttcctacctacctgttgatagtattattggagagagtcagatgcaggaggattctcaggctgctctgagcctggctttagggcagtacctgtccagcctgaacactccaattcagacagctcacactgacagagagcctagattctaaggaaacctgaattcttcccagtaaaatgggagagcattgggtgggctgtttccaccccaagtcatgaaaccgtatcttcaatttggcaaaatagagagggaaggggattttcttctcccccttttaagagtaaaggttatgacagcctgtttgttgctggagattttcaggttttgcagtttggaaataaacatcccaaagatcatctctacatccatcgagtcattgtctgtctcaaagggctagcattgctttatatttattatgtagattcagaaggctaggtatcctcatctccagggcaatgtatgtggctattgcatcctgttattatacagtgatcaattctggctccatgtccttccctaaggacatgaaacatgtgcttacattgtgacttctacttttgagatgccccttaactgttctaaatcctgtttccttttccaagtctaatgctgtaccttaccgggctgagtagtttttctcctttccaaaggacctttctgttcgcaagttgttctgttttgccatcctcgataagggtgtccccagtgtccaggtgaggacaccttgctgtcatcatcagtcagatatgccttaacccttgagatatctctcattcccaaacttagttcctctcctgcacacttgctgacttgtgtgacagattgttcattttgaatattttatcccatctgtttgttctgattaacattgtaatctggaggactttatcttagctttttctttaatatcagcttcttgcatctatcaaagtaaaattcagctttgagcctatgaatgagcatcttagaactcataaggatagaatgtttgtcacacttaaacgagagcttgaatggtttcagactcttaccttaaacctttattatggtagaaattgtcatcatggaaacttttggtttgctacattacgtttgccttatagttcaatgtgatgctggtttgttagtttgtactctcagagaaaaatattgaaggtttttcttaaaacctacagccctacttgtgcctgtaactcttggggttcctgaggaaagaagcctacagacatactctcaggcctagattctcaaagatgacacagtactgatgaactgaaagactctgtcccttgtgctacgtcccaaggacagtatattatgcccttcattctcttttgtcttgaccatggcagacatgagattgttgggatgcacactggcttttgtctactctgttgctgtatagcttacatgttccattggaaatagttccttctatataactggctttgtcctcctctcccttcccctcatttcctcaaggtagtctcagtacagccattcacctgctgctttgagggacagaaacctaggcataaatgaagagactttatacgaaaacttgttgctttagactgaagtaatgattgcatgtttcagagattttcagtttcataggtctgtggctattccattcattgaggatcctctcacaactcagaatggaaattagttggcctgcattcatgtcactgcttatgtttatagcatcttttctttgcccattggatgaaaaacttttgggggaaacgaatcaagcttctcttttaattatatctgctctctgtcacaccttaaggaaagggctacaattgatttctaaatgttgctgctaagttttgagttgggcctttagttttgctgaagtgcagtcttgagaatccagaagatgcttgtgttttaaccttaatgtttagaaatctgtcatgttttcattttgcttaatgataatctttcaaccttgatgatgcctaaatcaataaaaccattttccacgccgatgggtagtttgtgactcagttcatcactttgagcaagtttccaaatgtctttttctgagaaccaaaaaagaagtttttggggtttttattttggtagttgttttttgcagaattcacattactcagtaattgctatgaacagcaggtaccttcagggatcttaaactaaatcctgtagttgtcaggatgtattgaattttttatgcattcggcatcttcccttcagatacatctgtagtgtttgatgagtttttcctttgttttgctcatgaatatatgtcatgactatgagaactatagagaatcctcttccctcttgccctggtattccaggtgttagtaaacctgtactcaccccttttacccaaatcccaattaactccacatttattaagcacctattgtgtacctgggcactgtgacccaattttgaaagctgtaggcatgctttcaatgaagacaagtaaatgaatcattgcaaaccaggacaatcaagaagtatttacaaggtacatataagccataggagctcacatataagctcagtgagtaagagagaatttggtctcagggaaccagaagagacaccacatagaaaaggttttgaaagatatttgctgttgacgaaagtgaagaacagagcctttccaaggggcaggataaatggtgtgtacaaaggcctggtgaccttggcaacacagagttccaggaactagacatggcttagtattgctgaagcagagagttggaagggg

SEQ ID NO: 1355 - DNA, 675 bp, Homo sapiens
atattactgctgtcattacaaatgaagatgagtagtgggtggtgaagctgcggaggagagctgaggcgcttggcatatgagggagtttggttttgatcctgtgctgggaagacatgtctagccacactggggtttaggtctgggagtgggggtgagacctgcaagccagttaataagttcttggggtagtctgtttaaaagattttgcagggctagataaagaatgaagtgagattgtgcctttgagagatatgaaggatatgacgttgatagaagttgatgagccattgactctgagagaagaagaaatattccatgatggccctggggtttttgactccaggaaccaggaagagggaggaaccacctgtacttatgagagtgaggcggggaaaacacaagaacctatattatacttgccccttttttcccctaaagctcagttattcacatttattgaagatctgttgtgcactgaataccacgggatatttattccttcattcagccagtatcccaaacgtgtatcccatgctggtcaagggacacagtgataaatgagatagatgagtacttaggcctcaccaataaacaagtatccaactaagtcaattgccaatgtggtcagtattccaatggctgtaagcaagagccgagatgagaacataaccctgt

SEQ ID NO: 1356 - DNA, 3251 bp, Homo sapiens
aagaaagagccccctaggcaggcagctgagtacataaatccagggcactcaggcaggctgtgccaaaataataaacacgggacttactattaagaccatctgagaaatacatcagattaatacatgggagaattaaagataccccgcttaaggagtgggcagaaatgcagcgaggtacaggaaaggagacttagtcggaaaaagtcccctataaagggaggggaccaggagggtgctgtcctggaaatcccaggaggaaaatggtcaacacccccagcactccacagagagttgaagtgaaggtgtgtgttgcatctggcaactggaaactcatggatgacttgagcatgaacaggtgccccagggtgggggtgtcataacccaggagagagtgaagcaaggacttggagaacaggggtggtggccactctctgtgggcagctaaatacagcagcagcgcagctatgatggccttgcctctgcacattcgtggctggcccgtcagccctcctccctgaatcatatccccttactcactgttgctcactttgttgtctgcttcattgcccaaattggcaatgacagtttccttttcacctccctctggaagctcaaatttcttccgtagccttatgactgttcctttgtgacatgtttaggtttggagtttctcttactgtaaagccctgaccgagcgtctctggctcccacacaccacctcttgctctcctcctgaggccctggtaccccagcccctcccctgcagcctagtccacaggagactgaagcctggccccacttgttgctcctctcctcctctccacgcctgacctgcaggctctgcccctccctgagtccctgagcccatttcctcccactccttgctttgcccaggcctgtttcgtagttgcttcctttcatccttgtactttctttatgctcttgactgtgtcttctgcaggcaggacagacttacaaatcatgcagggcttgccccttcagtccttctgtcatttctagttagctctcacgttgctaatattccatgacgccgtccagtaacctgggctgcccttgctcctgaccgcctctcccccagcctggtcagggatacccctagagcagaggagaaaactgagctccaagcccagagcttccagcagctgagtggctcctgttgagagcctggctgtcccaactgtggcagcattcgcagattctgggcatctaaggcttaccagatacaaaggatggaagcagaaatatgcacagttcaaaaatgttgcttttagcttctagtgtgaaacttacagtaggagatcacagactgttttgcccctggaatatgtaggtcttttgtgagacaagggggagggaggaagcgaggaaagagtgagagagaagggagagagaaatgtgtgagagtgcaaaaagtagatttcaaaagaaattcattaaaaataaaacataagaattatggagcatatgctgcatggggaggcatggtctattcactgctattgtgtgtgtgtgagagagagtgtgtttctgtgtgtgtcttcactcaaggcagtggtgggagtagtatattgataagtgcacagtgatgggtagaacattatattctctaatggttttgcttgcttctctttacacatctatcctgttatcagaagctcaagtaatacctttaaacaggaatcgtaagcttcaagatagagaccatttgccttctgggttaaagattgacaggtgttggggtcaaggaatcatttgaattcctgtgtggagatggcccatagaagaggaagcttggaataggactctatctgaataatttgggaaagtccttcttccgttggttgaaatggaaatagctggtgtctcacacagatggaaactggaggccctggaccccagcctcaccctccatacacacccatctctagtgtgagtaagcatgttatgttaatctgagctgtcttcactacctgtaactagtcatttgggagtgacatcatggtaactgagtaatccttttgaaacttacatagtagagccaagatattaaaatggtcctggggctacctagatgaaagtagatacaaagtgtgcataaaattgtctactaaaagtagagtcagtctctatcagtaggaacttggtttttgtgataatgtggtacattttgtaactagatagatctcaaaagttcatacattgtagttctggtactgtccttatttccaggcagatagaaaaaaagaaaagaaaaaaattccactaggaacttggttgtaaattctgaaaatgttgatcttaaaccttattaatacaataaaaggacctgtgggaattttagctacattaatgtctattggacatgcctatttgagaaggtaattatactaatatcacaactgacatatcatggttttattttaaagaaaaaagaccatagcagagaatttaggctttgatcagtacttgaaggtaaaatagattggtaagaagaataggcagtcattactgtatatctcttatctgaagcaccccattgcttactttattatagaatcctgggaatttttacattctgctttgtggtcctacatttatcagtgactgattttgtcagagtttgggggctcttagcaaactgtaattgcaggcagtagtacaagcaaaatgcagatcttgacatctggtaggccaaccaccatttttattctgaagttcttgaataagcttttagctgttcaaagtaagtaccagcaccttgtgcccctggaaagtttctaacctgacatggaagttcaagtggcagtatcttttagaggtagtatattgggttctgagtgaaaaacctaggtggagggaatgagaaactgaaaatgtgaaatttgctgaggtctcttagggtcatagaattagaaggggaagaaagctgatggatttaccaggcccattttgccacatgagtatttgttgaagctatcaaacaaaataaaagctgtaaagaagtatgctttattctatctaattttaaatgttacagtgtatgtttatgtctcacgctttactgggtttcttccttaagagtcgttattggaatattatgtagtcattgacaaatttctcagctatgaaatctgtagaaaatcactggatccatagcttacataaaaatcacttatgcccctttcacattaatgttttctaaaatgcaataggatggatatatttaaatt

SEQ ID NO: 1357 - DNA, 2206 bp, Homo sapiens
gtataagtataaaatgttttacttttatagatgtatgaaggggttgagggaaaaaattatgtttggcatgggaaaaactgccagctgaataaagcactcgaggaaatatggtaaatgaagcctttgttactgtaaaacaataggcattaagtggctattatgtaatgttatttcttatgtctgatttgagtggcttgttgatcttggaacttgagatataattcctgtaaaaatattactttcacttggctaatctcaagacttttgatacaaaaatcaaagacttttccaaatagattacctagatcaggaactaagtactggagctactgaagctatgtcagattttttttttttccatgtaaggactgattttatctacttaactattccctatcctagtacccttccagataaacacaagtaatttgctaacccaaaaactggtttattgtaaaattaacctaggcttgctcaaccactgcaaagggcaggcatgtggcaaaacaattgataggcacatcagttgccttggcaagttgaatggatgattttaagttcgcatttccatagtaggtccctaagcagaaggatttctcatctttgatgtcaaatggccttagtgaccagtggagctaaacagatgtgggataatttgggtgctttaggtaatagttcttgttatggattctgcaaaataagcctctaagcgtatgaatcataatttcctatatgttttaggatttgatgtctggggttacgtatttgaaccgtggaataaaagttgccgtatttttactgtgtggcctgtaaaacttatttgtagcattctttctcaatagatgccttctctcctgtgaagttcaggcaggttagcctttgaaatcaaggatttttaaagtgaaaaatcaatagtgactttcttaacattggaatccaggcttaagatcagagacctgctctcttcagtccagttcttggatcttactgcttttaatgctattttaccagcatagccatggccaaaatgccattttagcaggtagacttcatttttctataacattgtgattatgtattatttgatggcttcttgtagaggaagctctttaatcaagagcaattgtggtttttcttaccttttgagatttaaccttacaattagtctaccttctcacatcagatctagggtgatttagaggtcaaagagaacagatactgaactggttagctattaatatgatacaacttctttatgccatttctcggatatagagacattccatggaatgggtcccaggttggaaatccatgagggaaaagggttctgactcttggcactgataaacatattcagaaatgttgtattccagccagagtaaatatatatgccctttatactttttttcagttagcagaagttacttctaaacacttattttggcattaaggaagctcgtcatgacctattgttccagaaagattatagtcctcgttttaagccagttctttagttcccatgtaagtggcatgcccagcctggagctgaagaaacaacccctgcttttcaaaccttccattcttataggtgtgtccagcaggcagtggcttgtagctgttccttcagccacttaacaggtttgatttcaaagctttttaatagagaaactaacatgtttggaggggattcatggcccaacatttatggattttgttgggaagtctcaggtgtgtatttatcttaagtatatgttaaggctattagacaaaagtaattgtttgtgctttgctctgttttgtttttgccgtctagtcctagactgaatttcttaagattatcttagggattggactgggagggagtagttccgagtcccgaaggctatatatctccactttcagttccttttctttggctgcctaaagaggagcactaaagaggagtcaagtgattataaattcggccaaaagacagagaaaccaagagctggacgattaacctctgaaacatgggaagttaattacatttacaaatacttggaggggctatttatgagtcatgcatctctctgtgacccttttactgctttgggagcttgtggatgaggctgaatcactctctgaaacctgataacctgataacctagtttggctaagtttggcttctgtgaacagggtctgaggatttatcacatcacgtcatttt

SEQ ID NO: 1358 - DNA, 81 bp, Homo sapiens
acatgcggtaactggtagatctgccaacatcagccgaggaggagggagggggaggatatctgtggagacagtttgatatag

SEQ ID NO: 1359 - DNA, 861 bp, Homo sapiens
aaaaactttactatcttatggccaaaagaaatacagctccaacaacattctaattactgaaaataatatttgtaaagcaagattttagtacctttttaattttataggacagtaccctcttggcaattcaaaagatatttgtagaatatagagctctgataattttgatctttggtacagaaaatgctgctgctgtctgagggaagagagtgaaaaatagaagtaggttttactttgttttaagattgctacctgctgattctctttcctattaatggaaattgtaaatgtattctgctgtaatttcctcatcttaaagtatcacagtttatgatggtatttaaatgggtttgtgcttttaaattgaagctttacttatggtgtcgctctgcacagctgctgtcttccaggcctttgaatgattaacaccccatgcactcaggcttattttcctgagctttccctgtatgtattataaaatcctgcacattcacataagtgtatatgttatctacacatttcaaaatccatgccgatcttgtaataatgcatatagttcatcccttagaaaggacaaaaattctttctgattatggatggcaatacaatgggtatgccagaaaatatctgttgggagattttagagatgatttacttataggcttctttccttttaaaaaatgtaataattcgtcttgaaggtgctattgctaactgtttttaaggaggagatgactcgatggcactcaaatacaccttttcctttgagaaaattgctgtgtttagagaacgaaaaagtaactgctttgtaatacataaaacaattgcataagaatagactataaataatctacaacacac

SEQ ID NO: 1360 - DNA, 396 bp, Homo sapiens
ctaagggtatataaaaagatacacaaagatggccgggcgcaatggctcatgcctgtaattccagcactttgggaggctgaggcgggtggatcacctgaggttgggagtttgagaccagcctgacaaacatggagaaaccctgtctctactaaaaattaaaaattagctgggcatggtggctcatgcctgtaatcccagctacttgggaggctgaggcaggagaactgcttgaacctgggaggcggaggttgcggtgagccgagatcgggtcattgcactccagcctcggtgacaagagcgaaactccatctcaaaaaaaaaaaaagatatacaaagacaaaccaatagaacaaaaatacatatatttctataggacaaaattgccaaaaaaaaaaa

SEQ ID NO: 1361 - DNA, 81 bp, Homo sapiens
tgtaaagaagtgaatgttagaattttcaaaaaaatgataaataccaagaaaaaagttattaagattaaagtagaatgagtt

SEQ ID NO: 1362 - DNA, 354 bp, Homo sapiens
catgtcagggacaagatagtgatgtattggaggggtaaagtcaaaacaattagataagagaactacattagaggtatttctaattgaaaaaagtaaaactgcctttacttatgattctcttcaattttctaggtatatgatgatctgaaaaattacaataaaaagataattaggtaaactggtaggaaaaataatttacataaatgtcatatatgcaaacatcaattggtttggtaaaaattataatagaagaccttatttgtaacagcaacaaagtagaaaatgcccagcaattaacaaaatgttcaaaaccaagataaaaaactttaaacattccttaaagacacaaaaata

SEQ ID NO: 1363 - DNA, 36 bp, Homo sapiens
tacacctgaccaaatgagaaaacgtactacatctaa

SEQ ID NO: 1364 - DNA, 375 bp, Homo sapiens
gattagggatactcaatctgtacttcttgagtgggtgtgatgaggctgcttctgagtatgccaaaagcagctagatgctacagctagagccactgttgctggagataactaccattgcataagcagtgccaatagaaacagaacaaaaaacaaaacaaaccaaaaaaaaaaaaaaaacccacgacctttctcccctctatcctgcaaatactggcagaatctaacaggaatccaggtattaacagtttagggaatgaagcttacaaagcctaaaacccaacatcacagagtataagagggtaaattttgagctgaacagttggtccattccactcctgtggcatacacatttgcacttccataaaatgatgattc

SEQ ID NO: 1365 - DNA, 74 bp, Homo sapiens
ttaagaatactttgcaacctaatgtttaaactacagttagccaccaccagtattccttagataaaggagaaaga

SEQ ID NO: 1366 - DNA, 50 bp, Homo sapiens
gcaatctatgagggtctatttctttgggtctcccctgctaccaattattc

SEQ ID NO: 1367 - DNA, 202 bp, Homo sapiens
ttactatgcatagtctattttacttttattactaatacatccactttataattggcctggtcatttagaaatggtttcagggactaccactttagcacattaaaagtattagtaaatgagccaaaccatgggtgctataatgtgtccaaaacaaaactaggattgaaagccatcctttcctacttcgaatatgttcgtttaa

SEQ ID NO: 1368 - DNA, 1552 bp, Homo sapiens
tgttggtttaaagaaaggcactctctaagatagtttctctgaccagaagagtacacacttatcaagcaaccacagagtgtatggcactaggcatcaccatcctctctgaggaaggtaatcataacccttataaagggatccactttgctacctagcattattgctggagcagggaagtatcatacaaatttactgagaaggttttgaatcacatctgggtgcattgtctcctctttacctttttctagtgctatggttattttccacaacacacaggccctttttatctgtagctgggaaaagggtatttggacactgtaaggaaagcaggtggtagtgagaacagtgcacaggaaggttcagcaatacaaattttgtggtacaaagggcttgtttttggatacgtagacagactggagtacacacattgactaaccaatgcagtaattacaaagagggggttttgaagtcatctgactgagaagctgctgggaaggccaaaaatacccacagatacactttgaatctaattactagttacatttgctaaataacagaggtacagaaagaacatcttagctttgatcacaagaaagagaaaataatttagatggagatgctaaagggaaaaggcagtgaaatgtaatttataatttgtttacaaagcttccctaactatgctagacagcaattacaccaatcaagtcctctgaagtgactttgctgatgcacagatctaaaatctaggcagggcaaaaagtcagcagggctcaaaatctgagggctggagaggagaacagcttaagatcctcaatcctgtgatgcttgtgtgccaaagacttgaaatagagaactaaagattgcagcctttacttgtcctctaccctgacaggagattcaaaacgcagagcagatgaaaaaatggaaagagaggcttgagaaaaagtattattctatggaaattcaagatgactaccagcctgtcactcaagaagaatttcgagagtaagcttatgttctaaccagactattatgggatatcatgacatgcgcattaaggacatgagttaaacacattattttcctgaacccaaaactttactctattaggatgcctttatttactttctatccagttttaaagttgcatatgactccatttgcttacaaggtgagaagcttttgattacatccctgttatctctaaataacagaaactgccatctatatttgatttgcataacagatcctgttctccacatagctttagaatattagatctataactggccacaagaggcatgttttaggagcttacaattctatcttcccaaagcatttcgcactagtaacttgctgtctatacatgaaagtttattactgactcattctctacttccttcgaaattttctagactttttttatatgctgtggagctggagaaggaattacactacatcaatttgaagctaaatcaagtggtgagaaaggtttcagctctatagtattgagacaagtggaggtaagaatctgtgatgcaatcattgagca

SEQ ID NO: 1369 - DNA, 4158 bp, Homo sapiens
cagcccattgagcatttcttattcatgtattacttcataaacttgtgcccttttcaggcacactttaaaaagtactcaacaacctatcatcaaactatccttagggtcagaatgaagtgcctctgacagggactcactatacaatccatgcatattatgacaagcctccagtatacacacactggtacaaaggattttataatgaggtttattatcaaattctagaaaagtgaaagtacaagaaaatgcttctagttcaggcggcaggtctccagtagttcagtcagtaggtagagaaagacagttttctcatagttacagagtagaaaaactattgatgctatcaagtgcgtcaggtaccatgttctgaattcctttggccacagataaattaataaaggcttaggattctgggaaaccattatataagacccaagtaaagtaacctccctccattctttagaatttgaagccttctggaaaaagccaaagtgtagaacaaactccccagccacctacagaaatctcactaacatcttcaaactggaaatttacctagaccatttctaaggtgtaatgcatttaaggtttcccaaaaataaaatacagagcagggtaggcgtatcactgtcataagttatgtttggaaagtgtaaatgaggatgctgtaacagccttatttggagggttggaaagttgtgtgtggctggcattttggaaattggagagaaactcttctaatttttctaggctatgtaagcccccctacgatagccatatgttctcttagcccaagcaacatcatttgacctcagcactcaacttccacattgatgctcaatagttcctgaattttaaaactcaaatataaagacatttttagattactactcaccttcctcaggacaagctcttctcttaagagactgtacatccagtgttcttaataggataattcattgtaacaagaaatgctaactgttctctctgcggcttctccctagatctgcacaagggaatgaacaacatggcctttccctgtcttaccatttcccagagttgtagccagccaaatagtttagtgaccctgttgttccctaccatcgcccctgggtgggatcatttaaacaaagcctaagctgagggaacacttgaggtcttttttttttttttaagcccagtggaaaaacaaacatacatttacaatgacttagaactttcaagttcttttattataaaagtctgtacaatgaagtgccagacacagcaatgccattatactggtggacatatatatctatatattatttgtatatagatatacagtttttatttgtaccaaagtaaaactatcaccaactgcctaattctaccagctactgctcaactatgacacacaatactgtcacagagcataagtgctgccatgccacttttacatattctactcacagccaaacattaacattgaataacatattgaagcagctgttaattctaaaatgaaaccagtcagaccactgacttataaaaatatggtactcatatagatttagcattataaagaaggaatatattatttaaaacatttaaatagtgcatatggacatttttgcatgtggtatataaaataaaacattcatataagatacacagtgcacataaaattagatgtttggatacactcctatctggagactgaaggaaattatctgaaatgtacactgcatgatggattcaaataaaaatgatacatcttttggtattttcaatttcacttttctaggtatacattatgaataacctagttgtatcaaaaggaaaccacacaaaaagggcaggatttagtgcttttctttattccccaactacacattcactaccaggttttccctcaccccccaccccccagaaaaaggcattgcacacacgggtgaaatgtgaagtactagaactgctatttattatcaaactacttcatgtgcttactatgtaatagtgccagaagtctgaggttcatgcttccctcaccttattaaaggatgttgcaaaattccatttttatatggaataaattgttaatattagctagttaagaaaaccatgcatgagtcattgcatgcaaaacatgggtatagtcaaagtgagacagtcatcaatccaaaaaagcaccagaaaaaaaagttaacacttagattaagcctgacccaaatctgctgttgtactgttagcacaaatgaagtcaccattctgtaacaatgattagcagaatgataccgagacagtacctgaagaaaagccatgcaaagccaaaggaaaaaaagatatgctaagagtatatgacaaggggcataccactacacatcctgtaaacagctgctttaaacagcatgttatgattgaccaaagggtggtcccttaagagggcgttgttgtcgttgttttggtatggattttgctgattaaaataggaggggaaaaaaaaaaagataaccccctgaaggtacatgtgaaaatgcagtggtagagcccttgttaagaacagatttactttaggcataatattttgctgatttaagcccattgattgaacacacaaatctgagcaccatcagagttcctacatactgacatggctattttctcacattatctggaggtgggttggggaatagcgcggatctgatccagacaaatcacaccattgccagcggataaacagtaactcaggaaacagtaactgaagtcccataggcagcatgtggtatgattcagttctgtgtgtgatgtgtggtgtgtgttttcaatatactaagcgaggtcaccttttggtctaccaactgttatcttcatccgggagctgtgtgaccagcgaattgcaaaattttactaacatactacctgtgagaagatgtcactttgggaattaaacagaaaggtgttccatagtacgacttgaaatctcagtttgattttggttttctaggaaaacagagaacacagttgcgtatgtgcacttttataggcttttctttcaaattttcagtcattctgtaagaaaaaggcaacagaagaattcagtatgaagattttcctccaattttcttcagtaatgagaaacaaaaagttggtaataacaaaaagcttgcatttccaaagttcttgaagttgaaaggataaaattccagtcttttgctaaaaggatgtatctgtagtacaaaacaatgaagtaaaccatatgtttgctaaaggtggagaggacagtctgtggttaatatggaacatcacttacgctcccttgagagggcctacttactctcccatcatttgttttgtttagtggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctgttaaaaaaaaaaaaaaaggttattgaactaataccctcatccccaaggaacacttctaaaatttttgatggacttctctactgatagattaaatgatgctatacttataaataatcaacatagataactggaggaaacccagtattttaacaggacatccagtgctagactctgccaggtctgtgagtgtctattaagtgttggaggctacactgagtcatttaatacatttagttaactgcggctccagtgaattgagatgtaaaagtaaactatcttatctgcaacaagagtaattttctaactttatagtaatgacccaatgcaattcagtttaatcgctagctaaagcatcaaactatcctaactataagcaaaattttctcccaataatacaatgaaacagtagacacttggaaaaatgcatttctgcacttcaa

SEQ ID NO: 1370 - DNA, 894 bp, Homo sapiens
cacttcagatttttttttaaccatatgtgccaacctatataggagactcacaaagcaaagggaattaaagtacagatattttagaatttgtaatattagctatcagcttggtaagataacccagctacttagaaaaatgtttctcaggcctgagataactgaacccaaacttctggccaccatcagaactggaatgtatttttcttagtttttaaaaagagcccttccaagtcaactgtgcattacctagttagataaaggcatgtgccatactgtattataggagccacatgcctggcacactgttagacaccttggaaacgggcaacctcaacacacagtatgaacacaatggtctcagtataaaataaaaaatccaaactagttaaggataccactcctgtcatgggatcctttctaaaataagagatatctcatttcacaaccactcccaaaagggtaaggatgtagaattaaagaatataaaatcactgcaatacaaccaaggctccctaggacaatccgaaaatagttaatcagatgttgtttacactggctgtgactattcctggccattaaaagcagggcctcagagcataaaggaatgttttaaaatttttcagtgctagcatcctatatgcacaatttctaatcccacgtattccattatttcaacatatggtcagtttgtgagttagagaagaaagatgactcaattttgtgatgctcaacaaaccttccattttgttgataaaatgcttcttcaaattcccgcaacgttttgcgtagtttctttttttcagctctggctttccaaagttgttccaataattcaggcctagaattgaaatggtaaaatactgaagggcacacttgattcattatattcttaag

SEQ ID NO: 1371 - DNA, 97 bp, Homo sapiens
acatacaccatatcatccaaaggtaaagaagtggatatagaacaaaaagatcaactcgcaactagttcctgtactttgttataaatcaactgtagga

SEQ ID NO: 1372 - DNA, 680 bp, Homo sapiens
agatttttttttaatttttgaaatacagtaatgttttatttaaaaatgggaatgacaataaatatttgcaaatcacacttgaaaagcatgtgtcctttgataaattcttgattcatctcctattaattccttaatactcatttaacatcaaatttcttggcatatacattttattataaaaataggctaaaatcacaaatcagcatacatacatagaagctgctcgagaacttgacaatcggagatccagagccagtttttcttgattttcttcaacatcagattcagagttttctaatgaagactgtacctgtactgcagttttcaacatatcacctaactcagaggacagattaacaccatcttcttcttcctcctaaaaagatatccaaacagagaatcaaacatgccttgtctttgaactcttcccttagggaagggatcagataattatttctttaaaggattaccttgatttcttcaaaaaaatgtgcagtttctccttctatgattggctgtaacatctgaccccttcgcttggtggatggagatccctataacaatcaataatataaatagttttacattttaagtattcaaagtgtccagtgaagcttcccttcattatgttacgaatcttcaactttattttcaaaatcttaaacatttgctttaaatct

SEQ ID NO: 1373 - DNA, 47 bp, Homo sapiens
taaaaataggtatcaacttttttggtttgaggaccattctatactct

SEQ ID NO: 1374 - DNA, 404 bp, Homo sapiens
gaaagtcaccaggcagtcatcacctaaaggaagctgccatgcaagtagctgtctacataaaaatagcctgaaagccacagcaaaccagaaggttcagtgaattaattcataggaaataatgtaaaatgggctacatgctgttttctatttgaacccaagaccaatctatctacagtcatactatctaaaggttaatttggggacagcacttaatatgcatttaaacactaaagttttcatttttctttaaaaatgcacacaaataccaataagcattattttaagtgacttcttctcattaaaaagattaacttattttaaaagtcagcttatatcattatgcaaataaaaggacatcatcatggccaccacaaaactgatgcattttcaacgacatgaattta

SEQ ID NO: 1375 - DNA, 583 bp, Homo sapiens
gcagacattattagtttcctattttaaaatcagtaatctcaccttacagtgacaattatttctgtcttggctgtgtatttctccaatataccacaataataattttttttgggaagagtacatcttgataaaatgaaccagagaattattgcttattttacttacaaggacaggagtgatgctagctcttgtcagcatttgttttacaagcctgtatctatcatagagaggtttaacaatgtgcctttcttccttggtcacctgaagcaagaaaaaaaagaaattgtctagtcatcacaaatctaaaatgtccaaaacattaaacaatgacttattcgcccaatttcaaattttatattaaatacataggcaatcccccaattgtaggaaataatgctcaaaaaacagccctgaagaatgtaggccacaaaattgattcatgttcttttttaagacataaaatcaaatctttttagcaagagagatattaccggccttccatgttgactttcatagtaaagaagacttttctgaagagaagctttctcttctaccaaatgatctttggtcattttctggaatt

SEQ ID NO: 1376 - DNA, 205 bp, Homo sapiens
ctccactggcaccattaatattctcctcactcccacaatgtaaataattaggtagaaagggcagacgatcaacagtctagcccaggcctttgcttgcagatttgcaggcaaaattttcagtctcctgtacaatttgctcttataataagtaggtaccaacccctttgatggctttacattttatctgaatagattatgaatatgg

SEQ ID NO: 1377 - DNA, 723 bp, Homo sapiens
tcatttaatgttgttggcattttattggcattaagatgagtgggcatgcatgcgcatgtgcatacacacataggttttataatacaatatttattctaaaccattaagaaaatctggaagcagtatagtggaaagatcctggaaaaagctcaacaatgtccatttgtgacctcatacttctctattacctccatttcccttcatctgagttggcacattctttatactgcaatactcttctcacagcttttagtagtctaattagcagagtaagcaatgcttcccaaattcatttgtccacaaacaagctccatagacaaataaatatggtaagtctcgcatactctactaattaaaacaaacttgtccccttcgttctataggatcaactattaacacctgaatgtgtgttccacagaatatcctttaacactagaccaaataatctctctacttattcccaggactcattaataccaccctggtctctcatgagagtaaaattgaagattaaaaaaaaattcactggataacatcttgctataacaaatataactttagattacacacattcagtagaggatagctgagtgtagtctgtcaaatactgtgatttcaacctcaagcttgaatcagtcttaaaccaaagataatacatttgcataaagttgtagcaggtaggggaatatttattctaacataaaacttaaaactaaaagaaag

SEQ ID NO: 1378 - DNA, 307 bp, Homo sapiens
aaaagaaatttttttttaagcaaaagaaaagttaagaggggaagagatgagaatgactaattcagctctgttcaagggaaagaaagactccaatatttggatcatgagagaggtgtactctgttgtcaagataagagttccacattaggactattacctagataaaagttcacctgagaccatctactctctccattctccaagcaaatctcatccaatataagattaggttgccaagtgctttgatcaggactgccctaggcacaggctttactggggaagaataatggctcttcaaaaaaaaaaa

SEQ ID NO: 1379 - DNA, 86 bp, Homo sapiens
ggattgttgaaggggctgagtggcataatgcataaaatataaccagccaacgtggggcataagctaggagctcaatacatacagct

SEQ ID NO: 1380 - DNA, 110 bp, Homo sapiens
tgtttcatgctctttatacactcatcttgccaactgactccaacataaatgaactcatcagcattctagttttttcagttttattatgattcaattcttgaagtatttgg

SEQ ID NO: 1381 - DNA, 499 bp, Homo sapiens
aaatcagactacctagacatctctaccctgctatagtaattattttgtttcaggaattctaaaggctaatctgggcaaaaatcatagctcaagattaccttgatatcttctggaagacacctctcaatacgtttttctttcagtcttttaagaataagttcaagggttgcttctttagatggttttttctccttctgaatgaccttgggttcatcttcattctcttcatcttcatggtctagagaagagccaaagctttttggaagtgtgttactacgtggacgtgtctgaggtacaaattctccatcagaatttttgtgttttgcatctacatgtcagaaataaggacagatcagtaataattggttttagctttgaccgggtcaaagaataagcaaaatacacaacaagaaagtatacattaacagcacacagacttagatatttcaaagccaaataaaacatttaagaagcaaaaaacagcaagacagctattcta

SEQ ID NO: 1382 - DNA, 175 bp, Homo sapiens
aaatgggaaaattaggaggccaatgctagacaatttaatggtatcaactactaataaaatcaaggtaataattttcactgatgactggaaattggcattaaacaaggaaatctttaacagaagtataggggaaaattaagtgatactctaaagaggagttaagagacattatctt

SEQ ID NO: 1383 - DNA, 30 bp, Homo sapiens
ggagagagagagaggcaaacattatcttaa

SEQ ID NO: 1384 - DNA, 57 bp, Homo sapiens
ctttattgagtaaatttaaaccaaagtgatgctccagataataaacccctattttgc

SEQ ID NO: 1385 - DNA, 477 bp, Homo sapiens
cacatactcactaaacatccacaaactaaatatacttcaacaattactatactggtttgacacccagaaatgcaatgcctagtttatcattcaagagttacaatttagtctttgtggtataaacgagtcactgtgattagacattcttagtcttagatgaaaatacctaccaaaaaatcttaatgaaatatccaacaaaactcaaagctgcttaatatctgaaatatattttagataaactttataacatcagttcacttattaatatacaatctcaggtatctttcaaaaagatattactaataaaaacacaaaaaagacatttaaaatataatacagaactacagtactgtactataacacagtactacagtatgcaattttgaccctaataaaacaaaaaaaggtaacttttatttttgtcaaacagtgcccaagatttaaaattatcaaaagttgtatttgtgattctcagac

SEQ ID NO: 1386 - DNA, 250 bp, Homo sapiens
gcaaatatattacaaaatggcacataatatacctttaatttgcttccgcagttttgtaagctctgtcatccattttaatacctttggattggcagcaatatcactgtaggagggctgaaaaattatggagcagaatcactgacacttgtgataagcaatagttacattaatttatgtccaaatagtattttacaattcccacagcaaagactgctcaattctcatttcatcttattttaattagataggg

SEQ ID NO: 1387 - DNA, 1084 bp, Homo sapiens
tatgttctaactattaaaattctctttcccctcctccactccatccctcacaaactccctctcctccccacttggtacttgtagtttttgatagagcagaaatagcagtaacatgatttgtcaatgtaaagtatttgctttaaaaattctaaaagctgctttgccagtggaaatataaagatgccacggtgcaaatggcaagaatactggcctggaagtcaggagaccaaggagttatataatctcagatctacatgatcactgttcctccgggtatctcagatttgttacctttctcacacagatctaaactaatgcttttgaaaaactatcctctcagttctaatattagattaagctcactctggggaatgctacaaacctaccttgctatttctttccctttcaaactgttcctcaaattgtctgattttcttctgaagtttcttgaccagctgataaggtgttctgtcctctctcttttcatcttttgaactaaaggatgatcttcgaattctgaattaaaacaaaaggccaacactgttaaattttcaagtaccaacactgtatctcttattgccctgacatggcactattagcaataagtaaatcttaaaggtaaaaataagtccctaacactaaaggacaggtagtataaagaaacactgtaatgttacagaccacaaatttagctaatacaagtggtgatgaaaacagtttggaatcatttaaaactggtttggacaaaggcagcaaagaaacaaagatacctagcagctcagagctcttgtaactgttcaaactgcataacaaagtttttgacattcagatccatttaaagctttgataaaaaaagattaggaactgctcagcaccatttgctgcttcctttacagagctctgtatttcagcgatgaatacataaataaatgaataatacaccacgagaaaatgtctatttgagagcaaacttcaaacgctacacctcactgaactcagcagggtcaaaaaaaaccaaaacttacaaaaatgtgctctataaaatcagtgagaaagctctgaattctatgtctagaagactcaa

SEQ ID NO: 1388 - DNA, 392 bp, Homo sapiens
agactaaatctctcaaaagacttgggtacataataggaattgcctcttgtaagtacataaaaatcatatacctagtaaaagacagtgctttagatgaggaatccaacttttctggatcatgtaggaaacgctggctttgaccaaaatctaaactgcggtgtgataatactggaggacagtcctcttccaaggggtgatgattcattcttccagcttgtggagacagctgagcttctccagactcagagtcctcctgccaagacttaaaagcaggaaatggctctataaaacaaacacaaagaatagtaccatgggtctcttgattccacgtgggaaaaaagtcacaaaatatcagctatgtgttccttaaatcatatcattatgtagtggtt

SEQ ID NO: 1389 - DNA, 90 bp, Homo sapiens
gtgtgtgtgtatatatatatatatataatcttcataaagcctactatagtttaaaattattcaagcttcactttttagtccagagttcaa

SEQ ID NO: 1390 - DNA, 440 bp, Homo sapiens
cagagttctatttccatataaatttaaatttctgaacccagtggcaaagcaagaaaggacattgtcaagctctttaaaactcaatttaattctaaagatgttatttaatataattctgaacttttcaaaagatgttttatttacaaatgttagttttcaagtaggggaaaaccagaaacagcaagaactgaacagttctttcttagaaatttaatttaaaagccaaatgatgtcaggtgtatgacctgtccctcactgtcaaatagctatattaagaaaaagtgggagctgttccccatgttacatggaacactcaccaaatggagttctctgactttagaagaattctaatattcccaaaggaggagctaattcacctgacagcacctggcctctaacattaaactgtgatggttatcttctgctacaggattcctatg

SEQ ID NO: 1391 - DNA, 242 bp, Homo sapiens
cccaacagtgttactaagacaaaacttaatagcactaggccttcttaagcacatttactttactgcagttatcctgtatgccctcaaatgaaagctatgttaatacatttgatgtctttgcaaatataatgtttgattacatatagaacacatacagatcatacacacaatccacaaatataccccaaatacaacattaagcacaggagggaaagaaaaaattcccatctacacattagctt

SEQ ID NO: 1392 - DNA, 1346 bp, Homo sapiens
gagccaccacgcccggcagcttttttttaagtaactacacttaaaaattttgatgctattggctattagcaatagcgaaaatgaatgcaaagagggcttgacagtgtcaaaattcaagagtgatgttttctttttcctcacacaatagctaagatcgctgctttagtaatttagtttaactttatgcattagcaatttaaagcattacctttcctttcaaaataataagaacataatttagtttgtttttgaagcccagatcaatctgagaattaaaaattgggtacaaagcgtgcaatcccacaataaacccaacaataaagtgattttcaaagcaacccttgtacctgtgccccagcaaataagtaactggtagtaaacattttatgagaaatatcctattttaagaaaagacaaaagtaatagcaattttttctgggttcactttgaacccagaacagttttcctaagatatggggacagcaggagaagggcttaataaaaagacaaacaaagtgaaccataaaaggcaaaaaaactaaactatggtgaaccatacttaccctccccatctctctgcagatgcattgttttgaaatcaatgaggggaaaagtgatagggcatgacgctaataaaatggaaaaaatggcaaaaaatactaaagtgaacacacagcacagtcagaacaaaccatacacataacacaaagccaaagataccaaaaacatttccctaaaaccagttaggcattctgttcaaaaacgttattaaaagaaatcactactaactagattttaacaaacacaaacataacatttccatttcagcaagcaatgcaaaaaaggggggggaaaactcaaagtcgtgctattttattaaaactcaaacataaaactgaagaaatggaaattcttaagcaggtactgtttgaagcttttcagtgtaaatgattttaaaggaaaatatctcccttagtttgctctttgaaaaaatcctactgcatttcattccagagttagcaggagagaatctgaagatggtatccacttccattaaaagtcaaaactttgcaaacagctgctacaaattcatactggtgacagtcatgtgctacctgcttgctaactactactgcattctgctatttttcttatcctttgaggaaaaaacaaaacagaaactatgtacttaggaatagtgacatagggctctatttggagtcatcccacttctctacaaagagtcacatcaaacaaagcatgtctgattccaaggtatccagggtctaaagtaagttggtctcttaaataaataagactttttcatttagaatatcctaactcct

SEQ ID NO: 1393 - DNA, 1164 bp, Homo sapiens
ttggaggaatatcctaactccaatcaatgtttgcattagtgacaaagttagaagaaacaacatggtctacaaacagccactctacaaagcacatgcacagttcatggctgggaagttcgctcaggtgtctgtaactgtcggctttctgaaagttgcggacccctatttctggaagaacaagtaggggacctacatagacttgtttaggctgttgaaccagggcagctcaggcactgaaaatcaggcatcagcagcctacaggttacctcctttatctataccaaggtataggtgctggattctgacatggaaaaaaaagacagtccagtatcaggttctctttcagggagactcaagaacgctgacgctagacagagaaggtctatcctcttcagacaatgaaaaacaattattcttctatgtttaaaatttaatcaggactcccaggccaaagatcataaagaactatttatctgcatcttctaataggaagaaacaaaagtgctttatcagaatccaagctgcttcctttgaagactcatttcctagcaatgctgcaagggatgctctgtcgaccaccattccttttatttcagccacaataaataacaaaaaagaacatttaatcttcaactgccaccagtatgctaacatatcccccaacactgggaagcatcttcataaattccagatgtcctgaataacccagaacaaagcaaattaaagacaactttctaatttagtctaagttaaaacagataatatgccactgggcatgccaaacatctagacctatataaaaaggagggtggggaggagatggcaataaaaattggcacagacaatgacttggttggggctcttaaaaaaaaatgcctagaccttaaaaaaaaaaacaagacccacacacactccatttgcgatcaggtgagtacacttaaacagtgccaaaaggagtccgtggcactggcattagaattcctgttattgccagtgtatgtcaacagatacttgccaaaggtgagacaacccagggatcttcatccaagtgaatgaatatgtaactatccttaagattcttgagttatctcattgtctctttaccaaagtgtatgatccagaaaaactcctagatccaaatttattgcttgattcccaccccca

SEQ ID NO: 1394 - DNA, 2243 bp, Homo sapiens
tgtttgcttgttaaattttaacttctctcctttgtgcaaatttttagagtcccctgcaccataccttcataacctaagacagaaatacaggaatatggtacaatatttgtttagaagtacccttgaaggtcatttttcaaaaaagtactactgatgatactaaggacaaggtaattatacacgctctgcttaaactggtgagatccctaagccttaacatactgggcttccaaagactaggagatagcacctgatttaaatattaacaaaaacgtatgctgggtgactttttaaaaaaatcagttctaacatccattttcaaagctgttgatggatcagacaagaacttctagttcatatgagatgctgccccaaaatctcagtgtgtttcactaaaaacacccacttgttcatcttacatgaaagggagaacagaagatcaagatgaataaggttatccagaaaagggctgtagtcttatcattgcttagggtaatttcggttacaagtaacattatcaggaaaataatgcgtgtgggtaaaattaccttcccatttatcaccatcagaaacattcttcagatctaaatgtggaatactgacacacgctgcttccccttgaacaccaacactctgacctcctggtacttctgattcagtgttggcattcaaatcacatatcttgctactagaatcctgtattttaaaataaagaatatatttcacaactacggaagcttttcacacccagcttaaacacatccagcacatatccaagtgtagtcttcattagtttactgtgcctatacagccaactgtcccactcccactgtgcaaactattttcaaatataaacatgcagttttagaatatgtcttattggaagacaagtttggatcccaaattcaggaaagtgttttcacaaccaagtctcttgtaaccaaaagtggcaaattaagttgctgtttaactgtaaaatatttggtaagagtatttatatttaaatctttaaacctagctaacccacattaaagaccagacataacagtttaaacctaggcaagtttttaaagactaagacaaaaaaatagttcttaccagaatcaagtgtgacaatttatcactgtcaaataacaaatattcttccctaaaaatacaagtaaagttgttagtatattaagaataaaaaggctactatcattatatatttcttacctagattcctctactccataacacagttagcatttacaatgtgcgaggagaaaatgccaactggacacatgcccattctttggagccctatatctgaaaaatcacacaatactgaaaagatccacagaatcacttcgggtttagaaaaatcaagtaacaatccctactccaccccacaaaccacagcaaaaaagaaaaacctttataaaatgaaaactaaaatccacagtaagtagaaacccaaaagaatgaatgtataataaagattttataaaataaatgttttaaccaaataaacagctctattctctccattcttgagactttcaaagaaaactttttaaaaaggtatcactatgtcttttactttaaacttgactgtattctatcacaaggatactacttccaatcagagaaggttactacttccaaacctttccctcctcaaaatataacagtaacatactaaaaggaaattttaaaaaatttcagtccaccttttacttccccagaaaaactaacccttatttagaacaagtgttatagcaagctgtcgtaagtgatctgtacctattttaccagtcaagagagcacctgctattatacagtagattatcaatatgcctactgggggaaagttcttttccccaaagacacagtggcaatttacaatgacacatcgagatgtcacttctaaccggccataacagagtatgcactcaggagacatgccttgatctaaatattgcaagtcatcttctcatacagataattaccttattcttgctgagaataagaaatgaactaaatgctctgttaagcttaaaggcattcctttgcttagagtaggagcaaatggtaggatgagtaattactaccttagcagcctaaaagacctaatcacctacatttgagaagcatgaatgttaaacatacaaaatgtaatccacctaaccaaggtactctggatctaaaaaccagtttgctaacttatacacagttgaagttgaagaggagagagctttttc

SEQ ID NO: 1395 - DNA, 274 bp, Homo sapiens
gaagagtcctcactaaatgggtccttattgttctaccaaatccagatgtcactattctgggggtgcctgttaatgttgttaattttatatcttcagcccatagctccaatacttcctgggctggaagaggatgattcctgcctcctgaaaggaaggacaaggaactgctataaggaaatctgtggaccttcagagtatggggaggctccagagacgtggctccaaagaatttgcttacccttaaagaacaggcttcctacttataattaaaaga

SEQ ID NO: 1396 - DNA, 204 bp, Homo sapiens
tgggtgtaaaaaaatacaaattacacacttaaaaggaagcatattactgcctttatgactttgaagtctgttataatttgaatggggttagcaaaatgttgccccgtagacctattaagaagctcactttcatatcaacaaagtagatttccctttgggagataaaatgtcctttgcttgaggaggccactattcacagctcct

SEQ ID NO: 1397 - DNA, 667 bp, Homo sapiens
acccagagactcagggtgcagtaagtttaatccacccagccagggagttgggtctagacagctactcaccaggccacaggacttctgcgccaagatttcaggttctgacccaggtagctcacgagagtacaatggaagagacaggcttggtcttgttacagggaaagtggccagttgggaaaatgtcatgaagatccaattatctgcatttcttttctttgtttcaggcacctggagcatgaggtcagcatcagagatcattaaaaatgtttaattaattttaattggtggccatctcccccatctctcttttacttcatgggcatattgggcaaccttcctcatactccctcaggttctcctattttgcttacattggtttattccagatttttcttttgtttgtatttttttattggttttgatcagctccttttttcttcctttaaggtgtataatgaggagaaaaaagccacaaccattcaggttattcatgttttaaagataagaatctgatactctagacaaaaactggatgtggtaaagactacctgtgtgtctgcatgtgtatttcttaagaacataaggcttatttggaagaaataataaaatcgtgatagctgacgtttagaggatgcgtccctcatcgctattttagggtttggtc

SEQ ID NO: 1398 - DNA, 122 bp, Homo sapiens
gtgtaatcaatgctcctcatagcctaccctccatcgagcccagccaagatgatgtcttttctctctggaaaagttctcactttattgttaagtaatcatatgccgattaaatttataaggcc

SEQ ID NO: 1399 - DNA, 834 bp, Homo sapiens
gctcttagcttgtctttctgctggaaagccaagaagcaaagatgggggaagtgaaatctctatgtcgatttacaagccattggatgcagtgccaaaggcacctaattaattgccaatgagctacataaatatttattggcctaactaagagttcaaggaagggatagagcgcttggattggcactaaaatgaaaatctgctagaacagcgatacaaaaatgctggaacttacaccaggctatggccaagaggaaatcgcagggaaactggagagagagaatgatggggtgagggcagaaaggaatcacatcccagatgtgggtgcccagcctcaacataaggtccagattccaggtctcagagaagatgtggggacaggcttcccaaaggcctgtgagaagcagggtgatgggaaacaacaacaacaaaaacaaaaacctttgagaagcaaggatttgggctccactcaatctattccaaggccagaatgtccctttcctgtctgtgtgtcctatttttgatggtgtcaaataaaaatgtggatttcatttttgttttcttaatccacaaattggttcaacaaagttgtgaaattcaataaatccagtttggctccaatctggctgtcaggaggacaattgagggggatgagggatggagccaaagaatacacgtttcctggagcacccaaattctttctgttgtgacattcccatgagagaatgcatccctgcctgagggcaggggacgacagaaggcaagggcttcatccagacgctgagttcgccttcttagtacaggggctgtgccctttgcagaaagggtctggagtcc

SEQ ID NO: 1400 - DNA, 122 bp, Homo sapiens
gaaggtgtattgaccataaagccaagtgtggaaacctagcagatgcttaggacaagacagcataatagaaaaaaagatagatctagtcccaggctcagtaaaattcggggacatggacttta

SEQ ID NO: 1401 - DNA, 207 bp, Homo sapiens
aaaaaaattaaaatacgttgttaacatttcaacgataattatttacattttcatcataggctggtggagtagaaagtgcattctcagctgtactacctcactgagaccttagttcatctagacaagtgatctttttttaaataccctggtgcatgagcctgctacagcttctcctgcctttgagcctagacaaagtgcacatcagtg

SEQ ID NO: 1402 - DNA, 301 bp, Homo sapiens
tctctcttgctgccctggtcattaaagccaggagggacctaatgaatctaccgttcagatattttctcacagctcaagacacggtcgctggtccttgagctcccacttcctcccagcctgcctgtgactcaaggctgcacctagagaccccttctcgctctttctgctctagcgcaccagccaagtcgtgtcttggatgtggccagtcatgctgtagagagggatcagcaaagcgatcagtaggagatgatgagctgtgggctaagaactctggtgaggggagtttgtcttgcacacgtgc

SEQ ID NO: 1403 - DNA, 331 bp, Homo sapiens
gggggagtcagacaaaacaggactccctgagatctgggaagagattctgcaccatgtgtagtatggtgcataatagcagaacctgcctgctagggtggttgtgagatacacgctagaggagtcgtgcaggcagtgtcagagctgagcacatgttagctgtcgtcacaaaatgagttccgccgcctcccccctctgacatacagctcagcactcaatgccatgtaacttacttgttcattctttgtggctcttggtttctgctttatttcacatatcaaaacacatacttattaacaaaaatccaggaaaaaaataaagcagaaaagtgtat

SEQ ID NO: 1404 - DNA, 59 bp, Homo sapiens
ctgcataacactgctgggcatttaggaggtccttttcttctaaacaactcttccctaat

SEQ ID NO: 1405 - DNA, 51 bp, Homo sapiens
acacaaataataaggatgtgagatttgaatgacatgaataacaaatatgat

SEQ ID NO: 1406 - DNA, 225 bp, Homo sapiens
gatattctttcgctttatcttaattttttccaacaagccagctgcaatgactgcagattaaactatgtcactctctctcctctcccggacgcctcccggcaccaaggcagtggaaaaggagaggaagaaatgtaggtggcagagcccgcaggacatagcatcggatggatgtgcctgtacagcactcaggtcccttcctgaaagcagtctttaaagaattcgggt

SEQ ID NO: 1407 - DNA, 44 bp, Homo sapiens
aatcaagaaaagaaaggaaagaaagaatttggggaaggagtctt

SEQ ID NO: 1408 - DNA, 2086 bp, Homo sapiens
tgcaggtctggatgatgctgctatatgatttcaatgctctgcaaaacacaaatggatacagttatgtatatgtagaacattgtattcatcagaactctccttaggaaggcaaatgtatttgttggggggaagtgagtccccatggggacctgaatatgcaaggatggcacgctctcatagaagaaaaggagcaacttccagagaaaggagaaggcagaggaaggccagggaggtccagatagaccggcaaggtaggagaagacaatggtttgtggtgcagtagcttcctgtgccctcaccaatcatcagtaatggtcctaaactcatgatgtgcttgggggcagattttcctgtggaaagtggtaaacgggctgagcttcctgcacagactgacatgagccagtcccaaggcagctcttggaaacacaaggaccaagagaaagagggacgagtgaaaacacttgcccaggacctggcacggggtggtacaagcactgaaccaccattgagggcagagaaccgggatttgaatctcattgaatccaatctccagggcacaggacagccataggtgacaaatacatcatgttttctctgccgatgactgctacccactgccctcaacctgcatgaaatgaatcttgagggacagtcagggctggtctcatttccctcctgtcctttctaactagaatccgctcactagcacaggtgctgcagcagcatctccacaacccctcaccccccaccctcaccccacctacctcctgtttgggggcgcccccaccttggcagggcaagtgcccctgagccggccgtgggtgctctgtcatcggagggtgaaacatagcactctccccccagcacacgggctttgcaccctggaaaccatttccccctcccttgattggaaacaaagtcgaattcataattttacaatttttcaaaactgcctaactccaaggggggaaaagggagctttcagtaacccctattcggtagccaagaattagcaaggaaaacactgcttcccactctctaattgatgcctctgccaagggccccaggtatgtcggatcctgaacacgcgtctttggggaattagtctcaagaaacatatcctcccaggccacgtgtgcttcctgtcgcccgcagggctcctgcggtcccgctcgattctaattttcttaatacaaaaccatttctttttttttttttttgaaatgaaaaatgacttgttaaacccctcccgggtctctttttttttcctcccagagaaacacattaaataaacaaaagtgagacgtaaaatgaaaacaggggcccccgtagcacctgcagggttttaccagctcacattacaaagccccgtctgaagtgtcccgagcactgtttccattacaaatagccagttctcttgaaagtaaggcaaaagccaaattagtcagattacatcaggatatattttcctgtagcataagttctttggaaacacctgcctgacatatttcagacgtgtgccgaggcaagcccggccctcagtggtttcagggctcgtcaaagtctcaacaaaaatgggtgtttgggttttactgagtaagactcggtgagatgcctgtgtggaatgtgagttgccacggattgactttctggaaccttttagctggcaaggtttaactagctcttgtccctggtgccacgagggtccaggaactcaggcaacctgtatctgaaccttcctggaacagcaggggagagagacgttgtggttacgtggtcagagggcttgaagggcatggatggaaatgctaaaatagggaagagggcagagttgacgggcacagggtggggagagcaggacaccagcacactaaatggagcagacacctgtaggcaggagacgctgggttagagctgggggagacaccctatccccttgcttcttttcctataacccaattaacactccgcccttgacaaccttctcccatttagactttattatttatttgcttaccactcagtaaccatggataatttactttttcaaatgatctgtgttgctgggaaactgcctggtcaagtg

SEQ ID NO: 1409 - DNA, 111 bp, Homo sapiens
ggccttctatattctcctttgaatatgctcgaaacatttacaatacaaatggagtcatgcattatttgtgtaaagaaaaatacccataaagaatatttaaaagtgtgtgtt

SEQ ID NO: 1410 - DNA, 226 bp, Homo sapiens
tgtgtatgttgggagatggtacattcctgttgagtttctaaattctgaaaactgaagaatcctcaaccccaattatgtgatggggatagatggctctagggcctcactgggctctgagtcactggattttcatgcaccctgattcatccagtgctggccagcaatgtccattggcaagagcacaggccatgagagtgttctcctgccatgatgctggtgttgctaa

SEQ ID NO: 1411 - DNA, 637 bp, Homo sapiens
caacatacgatgcataataagggttttctgcatttatgtcttctaaaaaagtacgtggcagggtccatttcaatggattttgcaaatgaacatttgcccctaaaataaagatgtggattttgcccactggcagaatagggccacactaacagcgcatgtgggaatggggcaggactgggttcctctgcaccgtcagaaaactctttattgtgaagggaaagatccaagatacacagacacagagaagcctccagtcggcctcaggtgaggtgttccaatgggtcacccagaggccaaaagcagacagcaaagctggaggaaggtgctgaaccaggaccccaaagcctaggaaaggggggcctctgtgatcagggagctggggacctcgaggtttgcagggaggagagtgggggcaggtagggaggtgttccaccccagctgcagcaccttgccagagagtgtcagctgttttaaaaggccatggttgaactaaacaaccagagtctgctgaaagccaggaaactcttgacctgaagagcaaccgtagacgatggtcaaatgcaatacgtgccaggtctagcctgccttccctcccaaccagcagcgattgtaactgtgcaaactctgaaaccagtcc

SEQ ID NO: 1412 - DNA, 321 bp, Homo sapiens
ggtcctgcgtgccgcttacatggagggctttggaagaatgtgcgcctgtccccaaacaccagctcttacagctgctcagctccccaccgaaggctgagggtccctaccacctctcacagaaggaaacacgtggcacagaccaatgagacattactttaataatcagatgtgggcatttttaaagcacggagatgtttggggtcctccttccccacccccatcatctagtgaatttccattcttaccaactttacctattaaatgcctgtctcaaatgcatccccttctcctcatccccagcccccttgcctggatcggatg

SEQ ID NO: 1413 - DNA, 100 bp, Homo sapiens
caaatagtgaggatcgactgtgtttatcactgtcgctacccgatacctctttttcccacctgggagcagagtgacccacagagccagtcctaacgcccca

SEQ ID NO: 1414 - DNA, 662 bp, Homo sapiens
ctggccacctctagtaggaaaggttgtaactgaggatgggggagagcgagagaagggacgagggactgtcaggcctgggctttctgtatttctgccctcaattctctgagctatgccaggatcttcccacaaatcccccttttcactcaacttagtttagttgcctctcttaactaaaagagtccatacgaacactgcgtatgagaccgctcatgagccggtccccacccatcttaccttcattaggttcccacttcatgagtgtcgcccggggacactgacagttcctggaggcactcctcccctccacagtggctcaagctctcccctctgcctggaacttttttccttcactcttcagcttaacccatacctggcccttctctgactcccatgccgggctatatgcctctctcttcagagctgccattgcacccggaccaggatcctctcttatctcaattcatgacatcgaatgtatccgtctatagaccctgactgccttgagggtggagccagcctgaatatcacgtagcaagagcctggtggcggagtggtcaatggttggatttggggatctaagtctaaagatggtggaagtctcccattctttgctgaagcgcagaaaacctgcgggattaggcctttattaaaatatttcc

SEQ ID NO: 1415 - DNA, 247 bp, Homo sapiens
aaagttctagatggtaatgaaaagctgggcccttcttagattaactgttcctgaaactccagaagcctgtcaacctcatctgacacagaggaagaatttgggtggtaaatgccatatatgagagaggagagtggcctgtcctatgttatgaggaactcacactatcttgaaggagggatcatctcattttttactggctccagtcaatgggtgcttgatcaaaaactagatggtaaataatgtacct

SEQ ID NO: 1416 - DNA, 191 bp, Homo sapiens
ttaacgcacctcagcaaagcctccaattaatcagtcatccagaatatataagcaaattgaggcctcttgcatgaagaatgttggaccacaaacacaacgcagccgtgtcaaaggtagccagtgcatccaaccaccatgttcattggatctatatttctcaacagatcttaactacagctgtgtctacacag

SEQ ID NO: 1417 - DNA, 877 bp, Homo sapiens
ccaatacagtggaaagagaaaataaacgaaggccagttgtctgagagagatgacccagttgaggactgtgtctggctggttatttcactacactgggcagtaaacttgattgcatcaggtctccttgaggcctttagtagaccagcctgaactagtagaattaaccagttctgctggcaaggtctatatgtagcctctatctcctcgacttcaaaagactagatcaaattaatgatgagagttgcacattttccatgttatgtaatcattgtccatgttaaatgcttgctgggaatcatgactttcaaaggccctctgagctgcatgtaagagttatgtaagaggcacttgctcatgcgttatgagcagactggggcaaaaatgacatttaagatattgcacaagttttaaaatgagcggctctacgaataaacagagatttttaaaagaaaggggaaaaaagaatttataaacccaataaagatgtgacagggcccaagcaagatgaaaagaagtttaaagctgtggtgagccaccttccgatgccttccgaacactcaaatccaggctaattcctcttgcagaaggaggacggggtgtgtgctcagacatgacaacagccacttactgtcctactgccccacccatcaccaccactgagttgtttggattcaatgtagaaagcaagagaattccacatcaaggactaacccagtttccattccttctctggccttttaggcagactcagcccagatacctagcccagctcacccaggaggagctgagaaccccaaggtgggaaacagacccctgctctgcttttccacacatccagatcacaccagctaacccatcagagcagccaagagtggga

SEQ ID NO: 1418 - DNA, 249 bp, Homo sapiens
actgagactccccatgtttcattccaagtacccatcctcaccctcctagactctctagtcattggtgccataatctgcctcccattaactgtctcaggttctccttatttaagtatcccgaggtggaaccctcaactatgattgagctgaggctgagtgtgcaagggtggtcaccacgggtggatttgtggggagttttggttagaggagagaggagatatttgcaaacagcaaaaaactaagtctcct

SEQ ID NO: 1419 - DNA, 166 bp, Homo sapiens
caccttcatcctgagactgcttatctgtgtctgtgagatgctttcagcagcaggtatggctactgtctgtcctcaatgtgtttggtgtgagagaaggagagcctggctgcctggggccctctcaagacagcgagaaagctgcttttcccagaaggccccgtcatgc

SEQ ID NO: 1420 - DNA, 581 bp, Homo sapiens
ttcctacattgtgtgaattgtagtaaaagtctgtgaaagttgatgcatttgcaccataaaactgggattcctgggaaaaatcaaattacgtttgctttaatcacccttttagagccacctgtatctttacctgaccctcagccctctcccagacatacccattacatgagagcaatgggtaagagaccccctcagcctgcaccgcctattccaggtgatcactgatctctgcttcccaggcaggggagaggctcagacaccaataattcaatttattcaacaccttcacagcccaagcagtgtaaaaggatgttggcttcagtaatcaagtttctagtctggctccaatcattccaataaccccatttcttctcccttcagcttaatagtcctttgtctgactctacccagattgtgtttactagggaaatgtgaagggcagaaagtgatcacccacacaaccagtgaacaggcaaagagaaatttaacatcagacactggtagacctgaggccacttgtgagaccaaggaacaactcattcctcacactggccaatggctcacatcctaggcatggccct

SEQ ID NO: 1421 - DNA, 184 bp, Homo sapiens
tcatgtgagaggggatggccgggcaagggaggcactagtgggtccactgccttaggcttctgagaggttttgggaagtagcaactatcagcacaatggaacaggatagtggttgctgcacaccattgatgcctggaagaaggcaatgaaaggctgggcatgataagtaatcaccaatggaaagc

SEQ ID NO: 1422 - DNA, 72 bp, Homo sapiens
tcaacaaccccctatattggtgacatttttagtcctaagcacggaagagtgggccttactatgtaaggggcc

SEQ ID NO: 1423 - DNA, 141 bp, Homo sapiens
aacaagaccgtgctatctgtggtggagagctatgtacctttcaacaaacagctcctggcttactatttgtctgctcattacgaagcacttggccatgaaatatcaagtgaacacgcaaccagaactgcccgtcatgatcca

SEQ ID NO: 1424 - DNA, 242 bp, Homo sapiens
ccaccatcccgctcagcaatgtcatacccatacctctccgtcagtttcatggcgggccaggagtgggggaggggggtggttcccttcatggcagagaaggctcatgaacaggtcagctcaatacgaaagttcacttgcatgcttgccctcctcctggccccggcccacaccatctgaatacatacctgaacagggcatttcttccaggtgaggtaattttatgtgatgaggcaattaaactg

SEQ ID NO: 1425 - DNA, 718 bp, Homo sapiens
cacctgtgcaatctggataaggctcctcagcccccaggtttgcccgaggtctcagtgcatgagcatattcacgcaggaccgggctctaggtgagggcatattgaacagacgctccatgctgaaagatgtatgtgtaggtgggttacagagccccatcccctgtcttccaagttcctgccgaacaaaagttgagttgtctactctcttccaaactccatccaggaaacacagtgaacattcaataataacccagcgtttcctcaagaggatttatatatccatcaggagagcttatgaagtcaggttggggttttttcccctgaactgtggctatgtttggaagctggtttgtggtgtgcacacatgccatcctctcagcctgcctggcctctgagggctccacaccctctccctgagttctgctcggtggccactgaaacaacaaacatccctccactagtacacagggagctagagacaggccaactctgaccaattgccactgtttccaagttcacccagcaagctcgctggccctggttcatgttcttctgagtttcaatggggggcgagactgaaaattggcctctcaaagcacccttggctgaactaagttcatgaaaagaaaaaaaatcctgtgagacaacagctccaaaaaaaatttccccaggctgcagtgtgtccctccattgaccttttccaaagcggagtaaccatc

SEQ ID NO: 1426 - DNA, 61 bp, Homo sapiens
gaggtgcctggcacccagcagacgctcctggagtccctttaccatcattggatcaactttc

SEQ ID NO: 1427 - DNA, 397 bp, Homo sapiens
ggcttccgtcttatggctgacctcatccaacatgggtagagaggtctcaagaaaggaaatcaagacaatattttattgaaaagaaaaatattgaaaagcatgtcccccaccccagtttctgagattttgctgtcatcatggttgctaggctggtctgatatatggaccagagcaggggagaagaatggtgtaggggaggggctggtcctcagcaggcatgcagggatccatgacctcctcaacatgtcccctgagcccagggcaggggcataactcagagactgcatctgcaagatggcctgaaaatgcttccaaagagaacatagaggaggtagaagctctctaaatcactcaggaacagtgcattcctcaatcacaccaaatgactgtgttaacg

SEQ ID NO: 1428 - DNA, 577 bp, Homo sapiens
ccatccaatgctgcatcctccctaatcatgtatcagctctgatccttccacaagtgcccaccgctgtctgttctcgtgcaggtagacaggtaaatctgaccagttttggttagtccagggtagatgcagcttcttgacaactaatgttttagtgggaggggccaggggctgcccactccttgaactcattgattgccaaactttgctctaaggagcactttttttctgtggagcagcctcaggggagcattgtaattgcaacaaaaagcgggtgcctggggatagaggaggccaaacaggtcagggtctggccacccttttccactttaggctcacacacctgcccctggccccaccttaaaactggtctctgatacctactcgttttttgcagccttgatgctggactttgaccccgccccacctcctatgcaaatgtcaaatccttacagcctctgccttctagagctggttcctcagtcctcagacctgaaatttgcttccttcatggccctgagctgacccctaggtcttctacaacaccacgacacctctgcaaaagacaatcagcactccc

SEQ ID NO: 1429 - DNA, 849 bp, Homo sapiens
cccacaacttagaccaagaataatgctgcctactggggcactgggttgactgttacatttgcagaatctctctttttattatcaataatagctggaactgcttgacctgttcaacattcacgttaacagtatccaggctccgtttaaaaaatataaaaaagctctttataaagggaattggaggcccctaaagacaacactggcactaagtgggctatgagtggccccaggctggctccccagagctccataactttctagaacctctataaataggatgctttaagctaagtctccaccccaaagtctgctttgcaagcaacatgcctgcttctcggagttgctttctgctgctgctggcgatggcaaccttaaaagttgattaagatgagcaggtctgggtcttgtcattgctccttcattccttctacctttggaagctcaacttcaaggctcacccaaagtcctgaagatgagcggaaagcagcatggaggaaatatatacataattcactcaccctttcattcattcacagccactctgtacaacctgctctgtacctgagtttgaggatgggtagagtgggaactatttgatggtgtcaccacaaggacccaggaatgcctggatcctgccttttactgtcaccaccaccctccccacacagagaacctgaagagcaagggtggaagagaaaccagaggagctgctccatgaacagctgcccaggtgagccttctaccctgcagagcatcctagtgagggttcagggccaaagtaaggccaactctctatgccagatgttcatctttaaatgatcatgccaatgcaggctgagaacaaaagca

SEQ ID NO: 1430 - DNA, 121 bp, Homo sapiens
atacccaaagagagaaccaagtaccaagaggggccctgaatccccatgatccacccatacctatggagaggaaaagaaagacaaataaggatgtcctccctgatcttttgagccaggcctt

SEQ ID NO: 1431 - DNA, 161 bp, Homo sapiens
caatatgtagcatgtccagggaacacgcatggctatagcagaagtaccaaaagagaagaagaaagaggtgaggcttaccttcagaggcaggtaagctctgcaccgtccagattgcaggggacctattatacaactccttgacccttgccatgaccctcaga

SEQ ID NO: 1432 - DNA, 721 bp, Homo sapiens
ccttgactttgggcacaactgtgtgacttgctttgacctacggacactagcagacaggaggggaacaaaaagcttgaaatgtgcttctaaggttagaactgacctcttctactcttgccttttgccatgacaagaacatcctttaggccatcactgacctagaaaggttgagagacacatggggtaggcctgggactcaacacacacccagagaccagcccaggcgagcccagccaagatcagccacatcctcaccaaccacgcatgcatgagcaagagcaatgaatgcttatcaaggtggacatgccactgatgttgtgtggttatttgtcacacagaaaatgctgactgagtcagccttgggtgcttgggtaagatatttggaatttatcctggaagtggaagaaaatcatttaataactttttgcagacagtcctctcacaaccttccgagctaaaatatggggaatgaaattcaccctctctgcagtccctggcacggtgttggacatgtggaacagacacactaaatccttcctggtgaattcagggaaacgtatgcctttgctcaagctgttctgtctcacttaaaagaccttcccccaccacagccacctaatagacacatttttctacttcaagcatcctgcttagaaccttgccagaaacttctgtaagctggatcaagaactccagcagatattccacaatagacttggtt

SEQ ID NO: 1433 - DNA, 628 bp, Homo sapiens
caagtgaactcccccacagcttctagcacaaagctgggccagtggtcctcatgcagcaaatactaagttgcttggctgccaatatttgtcctaattaattaataccctctcctgttacttctttcttctcctatttagaatcttaaactccctcccccgagctactcagcctctgctacagtaacttctttattccattttaataatacctagactatggacagagtgacataaaggaaacccgtgagtcaaaacatctatggtaggaaaaatacaggtgacctataaagtacttcaccaactttcctgaagacttcatgcttggaccttataaatcatgggcgcctgtcccgcacaggctgggccaacacactgcagtgggctgcccatctttaagaggcctggtgacacaatggcttgttgatgcagggtatttatacagaatttcccacatcaatcttggtgtaaaaagggaggtgatgtcattcagcggtgaaacaagtatcatctgtagaaaatcccaagcagcctcggggacacagtcacacttgtttatttatttaaggttgcatgaatcgtaagatgaacactgaagctgtgctacaaagaccaggagctttcaaaacat

SEQ ID NO: 1434 - DNA, 759 bp, Homo sapiens
ttttgctttctcttaaatttgttgtccctaggtgcagaactgcaaaaagcatttcaaaactcagtctttaccaattttacatcaaatgggagaaagtggcatcaacagccgaggcctgtctttgaagaacaacagggatgccacaagaggtcactgcaggaatgctggttgggggaaaagagccctctcagaggactaaactagaacaacgcagtgaaacagggagccagcagcttcagagcctctctccaacccgtaaggcccttgcaggggactcagagctgcctctgcctgatttcccgggtcaggtagtgaaacaccagccagtggcaatcccagggctccacgtggcatcacagtcgaatggcttgttcttgggggctgcttttgttcaaggagatctttgttcctggggcagtgagaagagggaggagggaggtggaaagaggggtagtgcccaagaggtagtattcgtgggggaatctcagccatcctttggaacttgttgatcttaagtttaagatattttctttttttaattaatactatcagtataactatcttctataacagtatatgaaacatgctcgctgtcgaggaaatgggatgttccagtaagctctgttttcacagaagttgggtcaaggggtaaacgcagagaagcgtaaatgcagagaaacccccatcccgcacacaaacacacaaaccacacacacatataacatgtacaacatatccataccaccaacacaccacaca

SEQ ID NO: 1435 - DNA, 232 bp, Homo sapiens
caacagacacacgcatacacacaccccaactaacccaaactatttcccactcttctctgtggttcagaatcctgcccattcctcaagactcagcccaggcctgtggtcttggtgacaaccccccagggccactccttctggtaagaacgggaagttctcatggcctgtccctctcacctgacacatttcacatgctgcttggtagtgtgatgtatcttttaaattttaacca

SEQ ID NO: 1436 - DNA, 183 bp, Homo sapiens
attgcctgtgtgttgtaatttgctcagctgtggagtccaaaagcacttatgccttctacttcttttaaatgggcttattttattttatgctcaaatgtctcattgtgcttttgcaaaatgtgtgagtctggaagtcacctggggaagcattcatctggccattgacttggcctatttattgct

SEQ ID NO: 1437 - DNA, 87 bp, Homo sapiens
caatgttgaattggttttgtggctacagtgggaagaggacagtgaatggaagaatgtaggtagctgaatctgatacttaaaaaaagg

SEQ ID NO: 1438 - DNA, 47 bp, Homo sapiens
gatacagccctctgtggattccatgatgcctggcaaagtgctaaggg

SEQ ID NO: 1439 - DNA, 479 bp, Homo sapiens
gtctcatctgcattatcaacaatactaaatcatttggggtcgatagtacagtaaagtggtaaaaacacacacaactgaattcagcaaagcactctcagctcagctagctgaatctagttaagttagtatcatttccaactgacgcctaatttaaaaataacattgttctattgtttcctgaaatagtgtgtgggagtcagccctcctataagccctgatgatgttcttagagatggttattgatgtttgtcttaaaagacacccccagctctgactgtcacatctagggagctcacaaggtacaatgcttcttcagcctcctttttgtcttcattagttctcctgtccactaagttttaaaaggaccagggttcggtagatgtttatgtttcctgatgtatcttgggtgagttgtaaatgaagaaagaaccatagtcttgactttcagccaggaaagagagtaggaatccttataaaag

SEQ ID NO: 1440 - DNA, 27 bp, Homo sapiens
ccggccatgaaagggccatccatatgc

SEQ ID NO: 1441 - DNA, 1124 bp, Homo sapiens
ggaatggcttatcatcatccatgaatgatttcttccaaatggtgcctctcacattaccactaaatctttgttcctttgggatatgggattgcctttatagaaatttccctgggcacacatctacttacacatccagagacatattcttatgcaaaacatataagaaaaactctcctgatccaacttgctcatcacccttccccacgacaaacccaaaccgatcacacccacactttcatgaaaccataggaacatgtaggcaaaagaaagaaacaataacagaggaaatactgagaatggagagtgagagaaagtgaaaagaagcagacaaagggaacagaatgaaaagggtgatggtagtagaagatacacaaaaaagacagaaatgaaagggggcgtaccactgagtcacttctttactcttagatctgaagcctgaattacaaaacatcagggaatccaaatacaccgagtaggctgcctttactcttaccggagccctctgtcctagccttcagcccaactgctgggctgaagggcgagagttaaggttctataagcaatctgtcttgagaggtttctctcaatgaggagaattcccatctgaaatgcggccacctgggacacacaagctctggcagttccaaatctccatcagacaacctcctaaggagcttggacggcaacatggcatttaatctcagaatggcagctgggagatgttgacacttcttctctaattgggatagtatgcttttaaaataaataggtatttcaaatgctcttaattagacttccagccaaagtgctttctgtttgaagtttgctgattacttcaggcaaagctaggcgctactgaacctaacacctgctgtaattcagaagactcccagagagatgagcagaggaattaaggcacaagcctgtgattgaaaacatacagcagttttccaaaggcccaggaagtgtctgccccagctggaaggaccatccctgggaggggtggggactgggcagcagagaggatggaagatctcttgcccacaaagtcatggaaatggcttcccagaccgaagatgaaaattgcccctagagttgagtggtatttttcacatcattgtttg

SEQ ID NO: 1442 - DNA, 876 bp, Homo sapiens
tacgttgctattcctattgaaccagcaacatgaaggctgaagaagagggcagatgtttcagggccaggtggcagcccttggggacaactccatatccagggacctgccagggtgagcacgaagcaggatacagaggcccataaggtcaccttggtacagttttccagcagaggtcattctgccttcccaagcctggcccaaggagttagggccctggggcagcctggctctttgttgaagacacttcgcagaatctcaatgctaagtgtgtgcccaagtctctggcgctgggagggcagtgtacctgaccccagtcccagggccaacagtgggaagctcagagctccagttgccgtggcttaggtgcccttgttctatgttcctgatgtaatcagcagctattctatatcatcattattactactgaaacgaaacaaccaactttcctaataatacaaattaccaaagtcaaatgagccatcgtcatgactttagaggctctcctctatttccccaccattggccctgggtgctggatttctccgattacaggtaattgagggcccacaccatctcaaggggaactttttttgtctggaatacatgaatttcttatttaatcaaagttctccataaattgttggtcccagctagctggagaggaaatgaggaggttctacccaggatacccactccaccagtcctctgcaagctatactcttctcctaggtgacttcattgggtcacatatcaaaaaagggtgttttctgcagatgtccactgcttaaaaggtgccaagggcctcttagaatatgactgtccttgttttgtatttgcattcttcatgcgttaaagcgggttgatcattgcagtggg

SEQ ID NO: 1443 - DNA, 876 bp, Homo sapiens
tgtgcaacagacacgggtctgtaaacaaatgctgttttcatcattaactatttctgttaggattagttagtagtggctctgaaaagctcagataggaccttgagaatctgggacacagtgggtgaatttaggtggggatgtggggtgggaaaggaggggaggatgaggcaacagctggaagagtagggtgctgggtgctgatggccaggcgcaagaacacaggctggggaaacagatcctgttagaggaggggcatccaaggaaagctgtgtggatagcaacccttgccatccttaacctcagagagggttttaaatgggttatcttttagctgggtttggattcctaaaatcaggtcagtttatattaccttcatcctcttcctgcagattctctttgtacctacctagggctacttgctgtatatgccgctgggtgatttcttccttcaggtgacctgccaaagacacaaaagaaaactaccagtgggtttccaatgggctggaggaagactgcctcagaagcatgtggcaagctacagaaaaaaaaaaaaaaaggtagagtaagggaaacaaaagcaggcatagcttccaagaaatgaccttccatgattcctagatcgtgttggaagaagaggttgcaaaggcctaggtgctggcacatcagtgcaaacacacatttcacccttgagttcaatcatcttaggattcaagtatcttagcctgtcacccataactttcactgaggcccctattctcttaaatggttctttctattattaataaagggaaaagcagaatttggtcttttaataatatttaggcctactttaaaatccacatctttatttaagctacatgaaactgtgtcaaataa

SEQ ID NO: 1444 - DNA, 304 bp, Homo sapiens
tcgtgcatgaaggaggggtgaaacagcagcccggagtttgtttatgtccaagggctcagcacacttgttaaaatgtcagtgctgtctgtatggcatgtcccatttgggggatgtgatcaggccactgggggattccaagaaagcctggaaaattcattgcttccttgtttaagatatttctttcctcacataagtacattctatacctccaaggctatagctgaattgagtattcaaaagatgagtagatgaggaagcagtcacaagagactttatcatttatggagagttttagggcacctct

SEQ ID NO: 1445 - DNA, 2008 bp, Homo sapiens
gaaagggtctggggcacctgcatgtctgtgccttggtttccatgtgtccctactggagagaattatgcatagagagcgtggcaggcattgggactaaacaataattgcacccttattccatgtgggggaagggtgggaacttcaggagtgtgctgagggggatttggggaagtggaaacttgacccaatgatgagtattggtgaacctggatccaacaggaaaatgacttgacacctgagccagccacagccccaaatggatcttttccctactcagtgcaatttgacccttattgtccatataagcagagtaaagaagttggggacataaggctgctgctggactgagactctaggctgcatcaaacactgctgaattaaattttaagatgggatagcacatgcatgctccaaataaaaggagatattgctgtgacaaatgcaacacaccatttagaaacatctcttgatttagagtgagtcatcaaaagctttttaatcctgcagtatggagagtcagtggtgctttggtgccctgcctgtttcctgggtatccggcacagccttataccacgagcctctcatatgactgggtactgccttcctaatgagcctggacagtggcttgctcctttagagcacacactggtttgcactgcttcctggaaactacctccctgctaataagccttcccagtaataagcctccctgacaatgcgcctcctgacacatgcttcctcaagtctgtgcctccaaaccccatgccttgaccagagtaggtgtgctcaacctggtatgttacaatttcttcagcgcctattggaacgaccaagttcctttttcccaaaccctaaggaagtatttttttttttttggaatgaccaggtttaaggattctccactgcccctggtttgggaggagctgctcacgtaaataaagaggggattttgccaccacaagcataaatactcactctcagaacaacgaggcaccaccagggaacaaaaggtgggtctttataatgttacatattgataaaggttgttttacaatgccgctagtgatactcagttttggtgaattgactaacatctcccaccacatggcaagtttttttttatttcccccaaacaagcttccaaaaatagccttatggctgatacctaattgcatttctaacagagctattcttcatgtgcagataacagtctctgtaacctgctggatcttgcagctttatgggttttggcaaaaaaaggagttgagggggattgcagaattcactcagcatgcagcttgctgtcattaccacggtgataaatttgctggttttggcctgggttcctggacacatccccatccagaggtatggaaaagagatgaaatggaaacagagaactcccagcctgaggccggagacagtctgggagggaagtagggagcccagaatggggctgaaaaccaaaagggtaggggagggaaggaatgctctgcctgcaggagtgtccataattagtaatttttccttcagtaatttaccacagtacatgctagaaacaccttctctcccttttgatacattaattgatggattgtgggtggcagcggggagcagagcttacagcaatccacgggaaagctccagaggagacgggtgaccttaaatatgaccgcgagcagggtatgtggaggtggtgctctgtgtggtatatgggttttctctgttactgagtagttctagggaaagtattatcatcatgcagaagtgaaactgatttttttacatcagtattcagtcttctgaataaaaccattttccataagcttcacactctattttgcacgcatgctagtttgagattattcacgtgaacgctgcttggctggcctggaggagagctattcacttacgactccctgagtggctgtctgctgctcctgcaatttctgggatgctgtgcctcattcaacatgtttatgttgctatcaaacaataaatacttatc

SEQ ID NO: 1446 - DNA, 47 bp, Homo sapiens
cacactcgtagaaggctctatcctaacctaggaaagtcagtgcagta

SEQ ID NO: 1447 - DNA, 29 bp, Homo sapiens
agttattctagaaaataattacaaatctg

SEQ ID NO: 1448 - DNA, 1563 bp, Homo sapiens
ccagcatgtatgatatgccacactcgttttaggtattcaggcactttcagacatattggaaggatactacatggttaagatgacaggtcaagcggctaaatgtcaaatcaatggtagagatacatttagaggagggaaaggagacattgggaaaggcataattactacaggcgaattgagtaggctcagaaaagagcaagggtgttaaggtgcgcttgggaagggcacctcagtctgagagaactgctgggacaataatgcagaggccaagtatatactggtttgggacaggggcggcaagggaaggttgagtggaggactagggctggggaagactaagttgtattcatactggagtctggggtcctgggtaattactaagagctctggacccagataaatgctatttgtctgtttgactatactactagagtttctgggcaaaatctggttaatataaacatcagttgtagaactggggtgtggggagaatatgcagaatatgtttcctgcctgaggggcctctttgaaatggaaggtctagttagaggctccgaactctgagtgacaatttcagctgtcatgtgagaagcagtttttttggtactaacatggaggatcatgataaccaaaaggttagatccctaaaggctgtgtgtaaggctagttgtaaaaataatgggcctagaataaattgtgtaatccttacacggattcccaactaacaggaggatgtaaattctttgaaaccttaaaatcagacatattcatgtcccccttgctaatatatatttcatcaggctttatccaaacttgttggtatactttgaaaatgtattgagtcaggaactacctcttctcaccatagcagtggtggataaaatagaaaagagactatcaggaagacattgtgggatttgattatgagacatatttctgaagaccagaagtaggacggaaatgcaaaaatggtgagtggagctgaggccttgaacttgcaaagcactggttccagaagtaggaaggtaactaaaacagcgccatgcggaacagggtaagagtctggcacattgtttgaggctgcgggttgaagtgaggctccctaccacccaatctgtgagtgaaaggggactgatgaaacgtgcaccagatgttgcctggggctatggtttccaactcaatgcaagcccaaggaggaagaaacgtacaaactcagcccctctccagctgctaagcccagctgctcacgggctctatacagggtctgctcatctccagtactgttacggagcagtcactccaaattgtctttactggagttgattctggattgggggcctggagggtctgtcagccagagagggatgaacacaaagaaaaagagagtaagagaaataaataaaacgtgtttcgttaaaaatgggcctgcccagcaaaatgccaaaatatatgaataaatctcatgctaaaaaaaagatagtcaagttcaatagttggaacatgaattagttacagatgaaagtaattttctgggcaggcagatgaagacatttgttgatgcag

SEQ ID NO: 1449 - DNA, 34 bp, Homo sapiens
tttggccctgatacttcatgtctcatgtcctatt

SEQ ID NO: 1450 - DNA, 122 bp, Homo sapiens
aggcaaagaccttaaagtatgttgaggatacttaacgagattaatgaagggatacattttctttaaaaagaataagaaatatgtgacaaataggtataaatgatacaagaataggtggatag

SEQ ID NO: 1451 - DNA, 53 bp, Homo sapiens
gatcagcaagaagaaaaataaacacaaagatgggggataaaagaagtaatagc

SEQ ID NO: 1452 - DNA, 393 bp, Homo sapiens
gaccattaaaaacctctgtgtgtatgtgtatgtgtgtatctgaaaaccaacattttaggcaataataacaaagtgaagataaagtagtgagatgttcagtggggagttaaaaccagctgtgaccctggatgtggttgggaggaggatatatttggaacaactacagacattgttatagttactttttaactctagaagaataaaaatatgtacagtagcagccaaatcaatagaagatcagaaaaaaaggcaagggatgggtgttgtggggagggaatgccaacattttcacaattcgacagaagccaaggaagaagaaaaaaggaatcagagaaaagaatggggtataaatgatcctgtgtttggtgaaacaaacaatggcaagagctttac

SEQ ID NO: 1453 - DNA, 249 bp, Homo sapiens
gtaaataactgtgtgtttgtgtgtgtgtgtttgtgcacgcacatatgcccttgtgcatatatatgtatatgtatgatgctgtgaccatggaggttatgtgaatgaatatctacaatgctatgacaggttactgagggtggaagtggggtggagagtgaattgggtaggagaggataaagccgagcaagatcaaacaaaatagaaaatgtactttaataaaggcgcatgatttacgattcacataaaagc

SEQ ID NO: 1454 - DNA, 901 bp, Homo sapiens
cccactgcacttccttgatagggaaatgtgatgttactatagcatgctggaaattgcgcttgagcacctgccacacatgtgatgtcatctgccatgtgtgctgactgaaaatattcataaccgaagtctcagcgacagggataggggaaataaggagggtttcagcatcggattatttggcagagctgtgttattcaccagcagcctggcaaagaagtgaaggtggaagacagagagtcccagaggcagcccaagacagcaagggatttccattggcttgggggccaggggtgggggcacctctgagaagccttcttcccttgttgaggtcagggcaacaggtccttccatgggttcctcaaagagaaaggtccagcaatggaacatacagtgggaggccaggagtggcctaaatgctaggcaaatgtttttaagctgccttattctaaactgacatttcatttctccagaattcaagattcttcttccatttagtatgctaaacatcacagttgataacataatcgagtcacagagagagggggaaagcagctccttataaaagatatcaatactttctagaaaaacatcaccggaacttgtcttgatttccccccgtggggattttctcaagggctccccatcacctcggccctatcttgtggaggaggatgtgcctggtaattaatgaacatttcagcttgggatgaaaacaccagacagtagtctgggcttttcaagacagctccttgcttatcattatgacggtacatgataatcacattttggggaatgctctcatttacaaaaaatgaccaaattataccatgtctgggagacccaatttcttttgctgtgggatattcacttgggctacccaagtaatcaaaataatcacaca

SEQ ID NO: 1455 - DNA, 1082 bp, Homo sapiens
aaagttcttctcagcaaagggggatataaccagcttccaaggcctgccctggaggagtagctgtagttcacaattgttctttctgtttgaagatgtggttccggttgccagaaatgttgtggggggtgagggcagggcccaggtagccactgcctctgatttccatccttatatccccagaagtagcccagggtacactcttaggagtacctgggggcattcaaatctcctctactccagtgtgggtgggacaggtatattccatctgttcccaacatgctcctacttgcactggaggctagtttgtaggacccctcactaactgggaggtagagggcaggttcactgaagggacataaaatcaaccccaagcactgagatgtttgattttgcagtgaatatagttttaaaaacttggattctaacatgaaaacagcaagttttacatggctctttgatataaataatcaactctttcactccaaaataaaacttgattctactcatttaattttaaatcagttagtgcttaaaaaaaagtcagtgggaaaaaacaagccccaattaaggctcactgctggacaaacttccagctggcctgtaaaataattgcctaacacagagttggtgcttcatgatgtgggaattgttctccatttgaagagactggagattaggaggaatgtgttagtgagtttgtgaataaaagacaaaactgaatggaaatggtttcagcttccaggttcaaaagtcattgttagatgttgcatatgcacgttgcgtctttctggtgcaatgggccaggcccaccattgaatctgtgaggctccctgtgctctgtctctgcactcacctccatgggagtggcatgggggtggatacattagtgcatctcaggaaaaccatccaagggagccaacgggggccgagcccagcaggtgcactgggaaactgtggtggagtggggagccagagaaaggtggctagccttcagagacaactgaacagcagtgaaggcccgtcagaggagagggagtggaaaacggcaggagaagttgcagagggaatcctgggcctacaat

SEQ ID NO: 1456 - DNA, 2031 bp, Homo sapiens
tcatcatggtggtggtagtaataaaaagtaatgattatgaggtgggtggctctgattacaaataacactgcatggaggattgaagcaagctaacctattgcaattgtttctaaggtcttgatcacattcaaatatggcaggacatctgtattttcccctgttcccttttagaaaagcatctttcaggcctaaattaacaagttatcgtgggcccagcagactttgctgaagtgcctctctccgcctcggtggggaggaaggggggacagtcacatgtccttgcaattgtccaaatcagggtttcacaaagcagagctgtgacctttcagcactcgctgactccaactttttacaaatttagtttatctttactaaaccttctcccttctgatcagttatttaccctcaaattcaccatcactttagttagtaatggggtcttccatattccgttatagtcaaatatgattgatttctgtaattggaagtaaatgactttttaaaaagcttgcttgaaatgctggtggtaatggttctgttttcagagcctgggatgatttctatccccatcccgttattttactttattttattccagaaaaataacaccagagctctttctccttttgtttcctctgaggctaaatattttcaaagaggaaagaggaaggagagaggtggagatggacatcccaccattttacagacggtgcttttcaggagtgacatatttcaggaagaacatcgtttccccctccctgaacttgagttctgcctgcctgaaattccagtacgcatggctctgtttcttaccgatctcagtcctggtggatataagctggtcattttggggataatgcataataaggaaatctagggagttaggactagaaaaaagaggcaaagcagacaacataaccaaatgagaggtttttgcagtgaagctttgggagatgagggaagctgcagtacacatggcccgagaactacacttcttcagccaacaaaatgagtgagcagggggagcgggaaatcagaaggtgtgtaagaagggctgatggcacgattttgggtgctgtgtctctggggagtcaacaattccaagggctaatatcaggaaggcagtgaatacccagagagaagaaaaacagagatggagagggaattgccacaatatgcaaagataaaaataatttacaagcttcaggttgaatctttaggggagagagatcctgaaaaattttctgcgtccaagggatagtaaatggaggctaaatatacagagcccattatgatgaatgaaatgttattatgattctttagtgtattggttttaatgttttgttttggtgaatataaaaatatttgtagggacttttataggtttacttgtaaacttaatcttgcttttcacataaaggcgtaatccttaattatggctttttctatcacagggatgttcagttccttcgtggctagggacaggtggataactgtttcctataatgtgggagatgtgataatgtacatcccagagcacagcacttgtttctaatcctcatcgaagcagaagttgatttcatttcagctaatggagcatattgatcatcagctgctccagggtctaacaggtgccaggaggagaccaaaccttcacattctttgaacttgggaaggtaaaatttccagaataaggagcagcctttgccttctatgagaaagtctggatattatctttgagaaaaacatggctctgttggagacaagctaatcattttaatggggcatttgaggtttgtacatgtaaggtaaagatacaccattattttgggggaagctctaaaaatgaaataacccaaatgcaggtaggtgcttctaagtaagagttagatgttctatttagtattctgtcttcagaaacacagatcgggtgcttctttagcagaactataggtttgcagagctagagattaaaaaatatcttcatacagtttatctatgcctaaaaagtaatgcttgtactttggatgt

SEQ ID NO: 1457 - DNA, 2107 bp, Homo sapiens
gatgatgtggatgtgtccttgtccaagcacctgctgtagctctttgggaacagtgggcagtcaacggtgggatgaatatgtaggtctgatcttgtccccacctcacatgtgaatggagactttcatccaggtactcaatagtggtcacaacaatgagggaaagacacttttgtactgagtgagctgagccgggtcctgcgactaaagaaccgcctgtctcatcaggccaatggcacccccattgagaaacgctgcttttgaggaaagatggaacaagttgttggtcactggggggagtcccaccttgactgatgacatgcttgtgtcattgaagactgaatggcccagagttttggaaaacaaactgctataaactatcttgtgagagctatgggtccaggcagtgctctggagaaagtgaacatacaaataggctgttgggccctgtgtccactgcaggtttttcttggagcaggcctgcctgagggtgtgtggaagcctccatgaatgaggctggaagcctatgggtcaaagccctccaagaaaccagaaggagctttcagctgctctccaagaagcatttcttttaagcttaagcctccaacagtaccttgttcaagtttgcctcacctagtcagatgccatcgccagggccacagggtctttgaggcttggtagcagccaccagcaatggcaccattagaggatagcgtgcccagcaggcagcagcccctatagcacgagagcagataaggaagacagaggggaagggcctcaggcaggcgctccagagcagtgcttggaggcagtgcttgaagagacttctgggtacagtctggggacttgctttgatgggagtggattaatttccagcagtaaagccaggagggactttggccataatattttgggaataagaaggagacgcaccctgtttggctgtcacaggctggtgagtcctgggacatgtgggactcattgtgagaagtttcctttagtgctgtcacccctccaggaacaaggatgggtggcttataaaggcgagcaagaggcaagaaagctgtgcaaactggaaaagggcggcattctttcagacacaggctggatgattatattcctaactcatgccaatcctaactcacaaactgctgaagaaatgaaatctggttaaatgtgttcctttttgcccttcttaaaaatatcaaaagcaagtatttttcagacagctttataccggccacactggccaggccttgtgggctccaaaacaaacacacctgagctagacttggtcagcattgggaggccagagaggtggccaaggaattaataaaggaatctaaagatttttctctatccccaaaggctgccacttgagatagttcttgctttgggggagtcatgtgagtgtgtggcaaggagaggggaagagggttgtgggggagaagcttctgaatccattcagcttcatgcgacaggattttgactctggcctgtcactggaaacagatctgaccccttctccacggtgatatttgtaatcttttctctttgcagtcaagggtatcaatgaagagtgaatgtgtatgacatgcagtttttggtgagaagtttactgtgggccttaggatattttctgctggagacaatacacttgatgtaatgattttctgtaccacagaaatcacaggaatctgttttctaaggattgattacatgtcagctgactaacgtcaacagtcctttgtgggttggtattttaacaatgtggcagtgtttagaggaattggtggtttttacctggatcttaggaaatcaccaatgatgataatacaatgggtgaacaatgggtaagctaagatgttgcacgtacatgaagaagagataagtatctgaatggcaaataggtgcccctaattcctaatagtgtaacattatcaatgaggacagtgacttctaggaagttgttacagtggccggaggccagtagcctttctgcagttgctcaagtcactttggttgagaaagcctgcataatccagctcccattttcctctgtcttcttttcaccatctgagttatctcagaggtaacaccccataccccc

SEQ ID NO: 1458 - DNA, 824 bp, Homo sapiens
cctgttccttatttcttgtttttcattatccttgtctgaaaaatattactactgcctgtagttaatatagtctcttacaaacaaacctaattctttggcaacaaaactagcagagaaagaggcagaggaaatgaaacattctagctagtctattgcctgatttcttataggcctggctggtattttgggagtcaggtttgttttctggcctggcaaataggagtaactgtagcagcccttggttttctatggaccctattttaatagaatgcagactgcttagactttggctcacattctgcatgctgaggtgagctactctttcctcacttgctgcctcagtttccctttttgcagtgacacctcagataggaagctctgacatcagaagctcttcaattcagcttctacttggggcaatggaaaaggtacgatgtgttactgtgatggaaagcactgtcaaccaaccctggcagaggtgccaggggcatgagggactcaagccgtttcgaggactcatcctagaacaatgcaaacaattgtcctcaatcctgggtctatgggcctgtttactcactccgtgctgtgcccggcagaaacttgcagtgatttaggaagtcagggagagacatttctggctgtgcggaacctgatgaaatactgttttgtggagacagactaaaaaataaccaaacggtctttaagtggaacagagatcagaaaatctcctgaggcacatttaagaaacccatcaattttgctggcttggccatagaagggaaaattgcactgcaaatgattatctctgatgaaatgttcccaag

SEQ ID NO: 1459 - DNA, 1738 bp, Homo sapiens
ttttttgtatttacaggccctgcattcacttttttctattggataaacatagcagataatattcttcatgtattttaaattaagaatgtgaggatattgctacactcaaaatccaggtgactatttaaatgggagaacaacatatataggatccagatgccctccagttgtttgtattaactctttcccacaatcaccaggtataagatgatagaaacaaaatggaatatggctctgtaggctgctcttatagagagaccgccctagaaaacaagacaaagatttccttttaaaggagaaatctcttgatgtgaaagagtatcctgatctccgacatggatctcatatttctgaagcacaatgtgccattttcttttcatgatgccaaggaagataagatatcctctttccattcaaatgaatacaaattggcagaaaccatttctgattagtgttctacttctccatatctacccccaccatcctctatcaacacctgcctccataattatacaagcctatgactttaaaggaacctatactgaagttacctttattcacctttcccaaagcaaactataattggaaagtaaagtaactgttcttcaaaaacaaaacaaaaaacattgcatatgactatatgaaaatttgtttccaatgattcataatgtttgcagcctaggaaattctgttagactaaaattcttctaaggaatttttctcctcacttttttctcacagttacatacaaccttctttcctctagcatgtgagtaaagtttcagtatccattttaccactcatactggcaatcctaatgacccattcaattcaacatacatgtatcaataaaccaactctacaacatggttctagaagcaagagaaaaccccaagagtaccattgtcctctacagatttgctgtctagttggaaacgcaagacattgatggccggactgttaattgatggtaccggtatatctacctgataccttcctaggccagagagaggaccgtaagccacgtagtctgtagaagatgaatggcaggctgggctgggtgtggaaggcttcatggaagagcaatacctcaaagagtacagagtagaatctgaatagaccaagaagagcaaagatagtgatcaaggtgagagtcaggggatggcaatctagcagcggctaatagaccaagtcctggtattaaggtattaagtttcctttatccgagcttttccactcacctaaaagaaaaatctcctcttctgctattttgttaaagctcaccagactgcttcctttaaggtaaactatctttccagtcacaacaaggtccacctaggatggcgatgagaacacaatgcctctcttcagggaaagaacagataactaaaagagactaaagtcaaaagaggaggttattcccttgaatctccttgatctgcctccacatactcaccaccaacatacacctcctccagggaacagcaatgagtcttaaagtttcctggactttacagagtcttttgggtttcaccaggtgttcgatctctaatttgtatgtgactctatcaatcaaaaaaaaaagagagagaaaacacaaatcaaaatgaaaattattagttttttaaaaatcttgttgtttggcttaatgccaaaaaatgcttttctcctgctatgctattgcttattttccttttctctcttttacaataagcgcctattgtaaattacaaggcac

SEQ ID NO: 1460 - DNA, 1220 bp, Homo sapiens
tgccctttctaattacaaatcaccacctgtggtaaaattattgaaaaacagatgagcttttcattccagcaatagccctaaaacaagcagcagttccaactgccagtgtgatgtatagacaccacagagggcagatgagggattaattaggtctgtccttgcacattgccaggggagcacttctgtagaggtgattgaaaactagaaagagtggcattagtcttcattgttggttaaaggcaacaaaaataaagatgcaattgagttgacaaagcttcaaggtatgtggctgagtcatttggaggtgtcaaaacgatcaaactataattaattagctaagtgctatatttaatccctcaactttaatgaagaattctgcatccaagaacaaatagcaaaagaggtatcatcggtttctgatatttgttagatttggagggagggtagtttttaggggagaactaagcttttttttttctgggctgtaatgatcaacaccccctgcttttaatcttattgtcatttccctttttcttatagaacagtggtgctgttctctgcatttctatgaggggagcaattacaggcatacaactctccctgtcagtgtgtgaagtcttttcaaggaggcatggaagactgactgtgggttctttggcttttgactacttacagattccttgtaggttttctactaagtattgggtctatttcagagctgcagggttgtagcttgtggccataaaataataaacaattcataattatgatcaggaaaacttcactgaatgcctactatgtgtagagtacttccctctctttaaaagtctttatgcatgggacctatgatgattttattgtattttttcctgttttctgtaaagtttttgctcacattattatttttttaattgattttctgagcctcaagggagtagcaaacaggtgagggttgctctcttcctatggggcctaactcaggcacttagtggttccttgatgagtctcatgattcaactagttctaagtgaaggcagaactgaaatgtattaatatttagtattttaacacattggctataaattagcaaatttcctttctgcaattatatagaacttgtgtttctttgtattagtttccttttatttaaatttgtaaaagtgttttgttttctttttcttacattattactcatggagacttgggaaaacaccaccctg

SEQ ID NO: 1461 - DNA, 265 bp, Homo sapiens
gaattggagagaagataaccagtattcaaaaaagccattctttttagcttttcaatctgcaaaattattaacatatgtgaaaaatatggggattcccctcaggtgtcatgtaatatagacttcatataaaaatagtttctcctctcttttaaggatttatactaaaatctgtattttagtaactttttatatacaaaccactattaaaaaggaaataagtaaaccacattgataattatgcctaggacaagtattattatacctc

SEQ ID NO: 1462 - DNA, 1927 bp, Homo sapiens
gtagtttaactatttattctctacaaaggtcttcttgactaaagtaatagcataaagtagtataatcagaaataactaacttattttctccctctcttaacaagcaaaatatggaagttaagcattttttatctgaaagttgaaagttttctcttggagaagagctattgtcaaagaaatgtagcatctgcccttactacaaaagaaaggaacattttagattgagaatgcttccaaaaagaaatctctgggaagagcaatcttcccattcattccgcatgctagtcttgctccagttcccaatatgttttaagcatgtgtcctgtcacaaaattgactgtgtatttgtttctttaatgcttgcacttggactattcatgtaattttatctatcttcaatattaagttccttagggactgggatgatatacataaaaaatggcaattggaaaatgtcacaaagcaagcaaaagttataactaaaatgtgaatgtgggcagtgttttgtgatcattccacacactatgaactttcttgagtgccttcctttgctcatgtgacaaagaaaaaaaagccctgggccacagtaacctcaagcatttgtggtgacaatggtagtgagggctccttaaatgcagaatgcaattatcacaaactttaacaaagtgaacaggcaatagtggacaaaccttcacccgacttgcctttatttcacatctatgacttgccaaaataatgtactagacactgagctgctatttaaataaataacaattatattaccataattagacatcttaataaataaacaagatatctattgaaagaaagttttggattaaacatcttgctttgtttaaatcccaaagtacaactttgtcttgtggttgttgtcaaaactattgttagaggtgaaatgtagttcgtgaatttttgaggtgtttacaatataatatttgctgctctttaatttttgaaggagatgagtccagctgtacatggagatgactataacctgtacatggcttaaagtaccaaggttcttctcctctctgcaaaggcagaactccaactatcctttggggatgccttcgtaggctcaacatgactgcctttgcttcaaaaaaacgagtttgtgctattccttattagtgagccacaaagtgggtatactaacgctggtggtgtttgaagtatgggagaggttggaaaaatgggtatttctagatgctttatagggagcaaggaaaaggcattggagaggaacagctgaccagttagctgtaaatctgagaaatgtttacacaaggagagacttaccctgggaaccagcaagttgctctttagttaatgctaaaataatgaacattcttatttccttgcaagaagtatgttactggcaagtgaggaggagagatggaagcttagaatgagctttcaacaaatgggtagaaaatatttgaatccatcccatctttctcatcttcatcctaatttcgcttgctttttcccagactgttagcacaagcaaagtgggggaatctaaaggcatacattcccaaatatattattcctcagtgtcttctgagttcagttcttaagaaaaatgtgacatggtaaggataactataaatgtactatttcagcacatagcacacaatcaaaaaaaaaaaaatgtcggtagcatattttcgtagctgacatgtaacagcacacacctctggggccttgggcaaactaccacagtgtcccacaaagttacctggcaatcaaggctctttacaagacaacagttacatttatagccttacatatggttcaggacagtgccggcatttgaggagtgccaagtgccaggtggctcttgaggccagttaaaccagtttcacactcttgcacacatcgtgtggctaggtcacttgtcatc

SEQ ID NO: 1463 - DNA, 678 bp, Homo sapiens
acttgtcatcttttttccccccaccccgcccgagttatggaggctgttgtgcaataattttctttgcatattcatagtacttttctgttattatcttgacatactcacttataatacagtttaagtgccagtcaatcttaggagaacactgaatctatttattgtcccagagtactttatttttctgatttcctcctcaacggctatagctctgttatgctacatctctgaagttactacttcccattgcagtggttctcctttgtagctggatttctgctacacccttttttttctggaattttttttggggggtaactgttgtatgatcctttttaaaaaaatcaacaactggattgtatgtcattgtgtgttccatctggaagacatcaaagatcaatagacacagatccttaaaaactgtcaaataaaaacaaacaccattcctccagttcctgtttccaaatcccaagatagtgctaactgtcaatagacatacctatagccctacacaggatttgaagagaccaggaggcaagcaagggctgcaggtaacttgaaagtggagtaaagaacacaaactgcagcttctttattctctgggaaaatgccaattatatatcttccatggctgttattttcccagatggcttggggaggggattggaacctctagat

SEQ ID NO: 1464 - DNA, 588 bp, Homo sapiens
ctctagaaatataggtatgaaaataatttaactagtcactagaaagtttcatttatctttcatgggattttctcttttacccatgaattgtcaattggtgagccattgcagttagcagtttaggttaatacagtggcagaaaaggcgagaagaggagatagagctagataaactgagactgagtccagaaatgaactgaacatgaattgcaaagccatctctaatcacccaaagtttcccctacgttccacagtaatttctgattgaaaatgaaaaaaatcaagttttggaaatacattaaatctctttctttgttttaactaaaggtctgcccaagcatgtttgcatattcaaaatacttttttttgcaatgtcagtctgcagaccttcaaattaaggaggatgtacatcctcattttattcagaagaagtatggttgtgacaataaacagctcacactgattaaatgaatctgaaaaaagataagttcacatttcagaatctcttgagtgattgaataagcaataaccaatcttattatggttcttgggggatagaggtgaaagaggtaatttcttaagaaatgtt

SEQ ID NO: 1465 - DNA, 131 bp, Homo sapiens
tatgtgtctcatgtcagagaactcagatatgctgggggtatggagagtggtaatgcttgtccaatcaggggagtgaaaagctatttggatactagaaatcagagctcttagtctgagaattacagactcat

SEQ ID NO: 1466 - DNA, 381 bp, Homo sapiens
tgatggatattaatctccacccccagatcctttgtctttctatttgtaccactgattattgcaccttctattagtgcctggaagcatgtaaacaagtcaatgccaagaaagtgtttatccctgtccaccactggagcaggaaaaatcagccagctccttttgctaatattcctgatttgcatttcagggaagtggagtcttttctctggaattcccttgctctctgctgagacaaagccccagtttatttacctttaggccacagtacaaagcagccagtttagtattaggagcacacactttgcagacttaaaaaaaaattctttcttttcaacttggctggttaaaactcactaagtgttaaatcataataccaatggg

SEQ ID NO: 1467 - DNA, 113 bp, Homo sapiens
gattaattgtgatgtttattttggtacatttgccccaggatctgatgtgtgttttcacaaatctaacaaataattttacctagaataccagacactgttcgcccccattagcc

SEQ ID NO: 1468 - DNA, 1333 bp, Homo sapiens
cagggttcacttgctggctgtttctttaatgtaattgccaacagcaagatcagcagtgggaattctccccattacgtggatcctaaggtcttagaaattcagcagttgagactcttctttttgccttggagtttggacctattaactaacaactttgctggagaaactgcagagggataaaagatggtgtgttttcagcattgttctcctagagaagaagcaggatatcaggttataatcatctgatttcctgtcagcctggttgatggctcaagtcaccaatgcccatgttaagggaaatattcgagagcattagtgatttgctggtaccaagagatgtgatgaacatttaaaaatactgcccctcgatgggagaaaatgtatttctattaagggaccagaattgtgctacgcttgttggagtttttgcttgtgcacaggaatttagctcgaggtctatgtctgtcactaaaattgacaactgcctatggctctgcacaattgaaacgtagatcttaaatttcacatcattatccaaataaaatatatctgccaagggggactggtattacacagttagagaactgtgataccagttgtctgattaacatattgagaggaatgtaagaatttcttagctgctttccagagggaggctggctggggagctcctgttaaatggactaattgatcagactccctgtgctaagtacagagatgcccagtaacgtgtctggtctgtggaggcagggttttcctgtcatacataatatcagtaacaacaacaacaacaaaaaggaatgggggccaattcaacatttccttaatcccatcttctaaatgggaaagatgagaaaccactagcccttgattacctggtccagagtgatagctcttgggcctcagatttactcagcagtactcagaaggaaggcacacacccaaactttcccttctcaaagccttataataagagccaacactcggataactgtgactttggagtatttatccaaagtaatactcctaaatatcaaatatgtaatactcctaaatatcaaatatggctaaatatcaaagccatgtaatactaaaaattacatgcttgttcctatgaggaaacaaatgcatatgagatgaattctaggtgaacccaaattattgtgtccctaatttactgttcttaaaaatgagggggcagtggtttactctaagagatacattagcagtcattagtacatggtaggtcacatgttttctggcttaaggcttaattccaaactcagatgggcaggtttatgtaactcagaaatttagatcacaggaagttaga

SEQ ID NO: 1469 - DNA, 524 bp, Homo sapiens
tttataattgctttaagatctaaagattagcaaataattgttataattattcccatggcatcacaaggattcattctgccttagtgtagccttggagagggtttctagaagtatcatctcgtgataattttcatcagcctataatctcttcctacacttacaggtatatttgtggttttcattcaaaaccatccaatgtcattctttcaattctacttaaattcacatcccattcccatccatctgcttttttacatcagtgtaatatggtttgaatcttgatattttacattgtggggtgttcagacatggcttaaaaatgtgagctgcaaactcaaatctggctttttaaagttactgtgagacctgaggtaactcactgaatctccctctccctctccttcttgttgacagagagaggaatttctaatttacttctccaagttgttcagaggtaccaacactccttcaatattagctactataactctaaataaaaagatttaaaaggataaacagtattt

SEQ ID NO: 1470 - DNA, 451 bp, Homo sapiens
ctgggaatactttaatttcctttctgccttagcaatcacttctactttctctggatttatatataattcattatcaatacttttacaggtgacatttttcatactctatcttgccttgcagttagggattagtcccttaaaattctaaccagtctgcacattttggggtgatctagagtttatctcatatgcatttgtttcctcataggaagaagcacaatgccttactctatacatgttcaatatagtcttactttacttactggtaaatgggaagatattcaggctactagtccttctaggtagtaatgttacagatgaagaattaactaaatggttctacttcagattatataaactacaacactatggagactttccttttgtattagtaccaaaaactgataagacattttcctccatgctatggtctgtagaccacgggtagata

SEQ ID NO: 1471 - DNA, 1222 bp, Homo sapiens
ttgagttccttgctgccaaagaagaaaaaaataaaactaaagtgaagaagtcatgctttagctttttaatctcttgtggcccattcaaattaattaatgtttatcaatttgtcctctgaaagtgactataaaaataatatcaatatatacaggcatatgttacaatttattattcaacattccagtttttttaacaaaaaacaagcataacataattccttgtaatccacagttcaccttaagtatgtatttacatctgtgtagccttacatcaactagtttataattttatgatactgccatgtctatatgcatgtggtgaaaccagatagaattgaaagttctaattgctttccttgtcaggatttcacaagacagtcttggattccaggagtcatgtcctgattcctgctattcacagggctatgtgaaagaagattgttaaactgggccaataaaacaaattttgtacacaagcacagcttttgtttactctgaaagctcactgagtgtcatttttgtttttgctatcaccttggggattgtgcatctccctagagaaatgttgcgtgagtaggggctataaagagttaagagaaaacagaaagtgagaaatgagagggaactccagtccctgcggcttcctatttactttgcttttaaaaaaattcccctagtctttactgagattcatcagtactttttgaaatcataaagtgtgttaccctgttcaggacccagagaattttatagtacatacaacttccctgtgggtcttaaatttagtctgatcagtattcatcattcctgtgaagaacaaacaaaaacatagtcccactgggaagacagaatctcaagcatgaattagactccttttgttcttttactctttccttcccttgaatccataacccagctctgtcaaagtcaaataactagcaagtaacatgaaacaataaagcatcagccacgtgaaacttctctaggaaaagaaaagtagtgggattcggaaccatgtcaaattactttcagagacccttgaaaggtattttttaaaggcatatcgttacgaagtaaaagaaaaagcaagaatgaacataaaaacaagaaaacagattaggaatcttaaatagttatagatttaccaactgaatatgaattttggcaacagtgccctgcaaccatgtacattttcttttaagaataagagagggagagaaag

SEQ ID NO: 1472 - DNA, 742 bp, Homo sapiens
cgttactgaccaacgtacaaagactttggcaacacaatactttgccctgccaacaaactaattgaaagatagaaggatgagagtccaaaaagtctaattttctttttgtgattatgttttatcaagtcatttgctttcacccagaattggagactgagacagcttgcatcttcctctatccctcttcactccttcaccacccatcaccagttaggtgaggaattaagttgaacaagattgaattcaaggatttagagaatgcaacaatcctatagctatattaagaactcattttagtccatcaattttccttcaaaattcttaggtaactatttgattttctaagacatcttggggaaatttcctatccttccttaattgagtaatttataatgctaatgagctatatgggttcacaaatttagttttctggtttacattcttccatggcagatttgtatgtctccttcctctcctagctgattgggaaccagagcccctgtgaaaaatacctctagcatttgtaagggagaagaaagacggattttgctgggatcttggtattcctcacagcacagactaaacattccaaagtgctccagaaacacagcatactgtaggttgaaagaaaactttgacaccatataattcaacttattaactcagtttctgtcatagctttgttcacacactgtaggaagtaaagttaacttccaccaacatcaagtaccttgacgtggct

SEQ ID NO: 1473 - DNA, 638 bp, Homo sapiens
ccactccatcttataaaggagcatgacgtattaaacaaggaagtggggacaatgagtcatggctacaagtgatgccatgactttcatataggataccatctctaaatggaggcaactttcttcttcagatagaaaatacattttttgtgctatttacttggagatgggtatgtgtgtggggggtggggggaggatcagaagtgttctaaaattaagctccttaaagccttttctgataattccaaacttaatgtaccaaaaaattttgtgttttgttttgtacccatctctgaaattattagattcttatcaatcttaccttagaagaatgtatctcatgcctgacttacttgaaataagtgtagaatgtgtattctgcaataggtgtacagtgtataaaattacaatatctcccacacagaagaaggattatgaatatagtaagtgatgcagtcatataaaactaagctgaattaggaggttatgccactctcacaaaacttttctttagaaaaaaattctggaaattgcaattgactttatatgtaacccagaaacacataaaaattaggaaggctggagataaaattaaaagaagaacattgaagagctgggatgaatggaggcataaaatatag

SEQ ID NO: 1474 - DNA, 276 bp, Homo sapiens
tataatccttgagacacattgctcaaatatgtgagaaatatagcttttgtgataaaaaaaagattgtgcttctaagtcccctatttatccccaaatggatgctagataagagacctacctactctctttgtttcacaggcctgatctgggctatgaacatttaaatgaaataataaccttccagggctctaaataggtctggcttgatgataaagctacatcagattttgaactttgaggcaattatgcaattgctcccctaattgcaacaggaag

SEQ ID NO: 1475 - DNA, 810 bp, Homo sapiens
caaatacctcaggacacctaaactaacagatacttcaactgtaacatcttctaatgagagaaccattgccacagtcacataatatgggtccctatattatcttgagcctgagaccgcctatctaattacactttactctcccactcttctacttgttttatgacacaatttacaagtccataaatttagtggaaagaatgcctgtctatagtgaatgtgagtacagagtattcctttagtgactttcaggtcaggtgctcacaaaattaaaattacatggattctctgtgtaatctccagtcaaatagcagaatgacagtaacctgattagaatgttcaggtttgtcccagctgaggctgattttgaatctgaactctcatacgctataagtaacattaagcccctgaaatttaaaaatgagttcaaatatttttaagcagatggaaatttacaaaggaactcagaagccttcaagtaatgtttagggaagaaccctgcttgctgttgcatttcttcattgtatgacactggctttaagatttataacctattacagtaatataatgtacgatgagatctaatctccagtaaaatcaagcatacacaataataagcataggagctaaatcaaggaatggtcacagctatttttctggaaagaacatcttaaaaaaaaaaagaatgccattgtgatgtcgtttcaatcatgcagtgtcaggaagcaacaagtacaataataagtttattgccatatactgaactcccatgcatgctcttttatgaggacttctcattcattgagttgcatt

SEQ ID NO: 1476 - DNA, 164 bp, Homo sapiens
ccagcttgtggattgctaaattggggtcaaaataaggaataaagggatcaaatgtacagtgatacttcaatgagaaacagctttcttgagaataaaattaaaattatttcatgtcttactttacattcatttcatttatttattcatttttaccattcattctc

SEQ ID NO: 1477 - DNA, 1446 bp, Homo sapiens
ctgcttatcctctgaaatcataagtcaaattcttccatatactaagaaaataagaaaaatggggatactattagggcatataaagaacatttctctttactctcttcaggctgtggcttgatcattaagagcttgaaggatcatggtcctctgatgacttcatgttagtgccacctgtctgggccacggagaacccatgatggaactgagaatctgaggaagagaaaaaaaagataaaaaaaaaaaaaaggatcatggacaggggcaaaatattgatgaactggagagggaatttctttatatttcctggcaagggtgagctctgaaactgatgtcatagacagatcttagaggccagctcccagtgggagtaaattatcttcccataaaattcatccatatgataactattgatattatcagagaggagtgtcttcaattaacaaagatgcatactcttaaccataccaaaaatactttaggctaatcaaaggtagacattatggaggaaacaagtcatgtttcatgtcattgataaagaactttcaagtattcttttttaagaacactttgatagttgccttggtggtggacttggatctgcatagcgtcaagcccttcattcactgtcatttcctacatggatgaggggaactattttagaaaggctggcatttccaagggtacctggttaactttaaggtctgtaagagtaggaccatgctgttttttgttatcactctattatcaaaatttgtcacagtcccagacccatgacagaaataacatgtacattggttaatgaagaagtaatttaatcaaatgcaatgattctttcccaatttgtgctattaaaaacaacaaattaatactctgttctattttaatgatagaaatctttttaggcaggtgagaatctgataatgtttatagttaaaaaatgtcattaataaatcaatgggttctgaaaccaattccccctgaaatacttctattgctatacataatgtaaatatttattataatccaatatgaaataaactccttaaaatttccccatttctttggagaattggacctggacttattttgagaataattaaaagtgaggtttcaccttggtttatgtcaaatcattacaccagaaaatagctaagaacattgttctttatagaatcatgccactagtattattatttattttgattaaaaggatttgttattagaagcaatattttctctcataccaattacatgcaaccaccagcttttgaaagacaaagtaagttgccgccagaatgacccacaagttcctattttcctttttgtctcaaggtcatgttaaaaaacatattcggccttgtatggctacttttgctattttctagtgttactgttcatatgtcctttctccagtttgggctgctatagtcctttgaagccttg

SEQ ID NO: 1478 - DNA, 1271 bp, Homo sapiens
gttgttgttgttgttgttttctatcaacttcagattgaactggcttccttctttcagatggcactcaccatgtcaatgataacaatcaacaaaagacacccatacacccaaagcttgcgccttactgaccaaaacctaatagtctacttgtactacctgccaacattcttaaaaatacacaacatactcatccctataagctcacagcagcattttcactaaaggatgaaatcctggaacatttaattatcttgaaagcaaatggtaattaaacacttttcctaacactgggaagctggggtggtgaaggaaagaaagctagggattggaatccattatgtggcagaagcttctgtctggtcaatttaagcagattggagcggaggcagtcgcacataaccgcctcaggtaagggagcgcagtgttcctgtggggttatcaaaccggccaggccttgaaggcagagcaaagcccttccagtgggaagttcttcctaagtgcttgcatggcatccgcgggattatcccaccccactcacacatcatctggctttaaactttaggccctctggcaaagaagagacgaaacatctattcgtcccctcctccctcttatccctccgttctgcctttcccatcctgtttcctagcagccgctggctgaggcctgcccttctctgccaagcaccaggctggattagctgcaagccaatagctgggggtcaggattaagaggccagcgtgcactttaatacaagctgcctataattaatggcattattaatagcttgactgaaaaattcattaaaaaatccattaaaaataaatacccttttacaaaaggcattgccttgggtaagaaaaacagaaaaaaagataaaggaaaattgattggtggctttcagttcacagaaagacagaccatagttcaaactgattaaaattgaacattttagattaagcacccttgccaaaatattctctgtagttacccaatatgaaaatattatgacatgtcatatatttatatttttatgtatcaagggttgggatataagacacacaggtagctgtttgaagtaactttcttcaagtgaatactcttgaccctcagtaatagcagaatgtcccgtgaaatgctggttaactgattaactcagagcctcaaatgcaaaagatctgttgagaggtggaatattccccataaatttatgacttggtgcaattgtttatctacttgaatattttctgcataagtgctagcattggtcc

SEQ ID NO: 1479 - DNA, 2033 bp, Homo sapiens
gcattcataccacagttgttcttctccgtatatcaggctctgtaacttggaatcgatcttatcgagttttgcctcagcccaaataaacagtgtagaaggtgactggaatgtctgtggttcggatgtttgctaggagaaaagtggtgatggaaggggaaagtcctgttgggtacacagactcccctgccccccttcccatcttctcccctataaaggtttgtttgtgttgatactaaatctgatcttttgggtcaacttttctctgagtctaatctgctcattggtgtgagatgaacattgtcttccagaggtacaggcgaccatgccctctgaaaaaaagaccccattcatgagagtatttgcttgaagagagcttttattcacttcacctgttatgttgtgcctatagagcacaaagccaagtggagattaggcaattatctggttaataggatcaacatagacaagaagttcattcaataggcatttctgactgcacaccacgcacagcacagccctggatgggttgagaggcacagggtgaagagagaacatgctgctgcttagttcctaacacaataaaggaaatgagacataaacacagtgaacaactgacatgcaatttacaagcaagggaagaatcatatgggattctatgtactaaagtggggaatatagcaagttaaaaattataagaggtggttaagctggggtacatttcttggaaagggaaatcaatgtctctatatgttcagaacgctccagttcacccccttttaaacctggtaatttcagacagtggatgcatgctcttttaaaatgaattaaagttcctttgttgccactacactaagttctcaaaatttatacttaagatggtatttaattcctggaaatactgagaaactttttttaaaaaaaatctgggattcacaggggcacccacggatattatattaacactctggcattgtttcagctctgacttttccctccttggtacttgcagaaagttattagtgcagtgtgatagatattaactgagcaatgaacttcccagtagaaagatactgattttaaaatgcctgtgctctgtgatttcctcttttgtttctaataaaatatggccctaattagcaaagtgttgactaacttcccaagtaggatgtgttagtttgttcaacattttccactctctttcattctcttcctataatttagactgatggtagattttccctaaactacaacatttgcaattttctgaggttctgaaaattaaaaataggtgctctggggtgagatcctcttgcctactactcctgggcatgaaattctcaacttacagcttttacttctatgttaatgtggaaacctacactattagttaaaattttttaaattatgttggttggctgttttgtccgtgtgtaacaaacacatttaactaatatattcctgaaatatctactaatggaatcaaatagtggtgttgacacactttagatagaggctgcatgtaggcaatagaagcaggaaggtaagaggggggaggagaaagctctgcagggcggaggcaggatgttggatgaaaggtacttgaggagatgatatcactgttgagccctgtcatttagcacctggcaggtcctccgttaagtaaattaggtgtaatagaacacattgattttggaaaggaaaatcttgactgttaggaaaacaagatcaagcaaaggctgataaggctattagttctatattttattcaaatactgtaatcccacctgtctgagtaggctaggaaatttaccaaacttcaagcacttggtgaacaacttccatcaaagagggatcaaataattacagacatgggatggaaggaatgtacccaggatgtggtgaaaaattagcaagcattaggaaatgaaagaggcaattttattaatacaatcatccacctttttcgtcactaccaaggtcaaacaaaacctggcatacattatgtaaacagatctcagttcagatgctggatc

SEQ ID NO: 1480 - DNA, 180 bp, Homo sapiens
aaggtggaagatggtgacaatacttttcccaaagttagacacataaagtcattaatattcaaaatggtaagctgcttctgatgacaaagtagaagccaatgatgagggcatgttgtagatcgaaccaagtactgagaatcattgttttgactatggtgcaaatagggtttgctatcattc

SEQ ID NO: 1481 - DNA, 275 bp, Homo sapiens
tgtcacattccaaaaaaatactgttttctgaatttagcaagatgaatggaataggatttgggattgctaattctaaagcctactcagtttcactaaaagtatttgctaaaaatgtttcatgcactcaatgctagtttaaattaaattctttctcagtgtcttttggatcatttttaccactatgacttttccttcagaaagaatctgttctcccagaatatactgctagatagcaaccattgtgccctatgccagtaattcatatatctatatga

SEQ ID NO: 1482 - DNA, 153 bp, Homo sapiens
acaaacaagtaatttgtcatgtgtggtacagggtagtaaaatgtgaaacccaggtaagctcagagcaatataggaacatatagatgagaatctctacccagtctgcagacaggtaattttatcaagagaatattcctaaactaatccttaaaa

SEQ ID NO: 1483 - DNA, 478 bp, Homo sapiens
ttcaaaaaagtgagagatcagttaatgaacaatgattaaaaatgattggaaaggaatttatggacagtgggactacacaggtaggcagaggacagtgcagaaagggcctggctgtgttatcttgaaaggaagatgttatttataaattcaccagttcagtgatatggttggctctacatcctagaacgactgctctgagatgcagtattaaaagtgagagtgctgctacagagatgtgggaacaggttaatggctcatttaatttaggaaagaaattatatgggtttgaagtaaggtcttatgaatgacagtagtagtaaaaataacaagtgaagtaaaaattatgaagattatgactataagagatatttaacagatagagtgttagtcaggatgtttttgagagaaagggaggagtcaagattgaacatagattcctgtattagtcaaactgaaaaaaaatcaccaaaacaaagaa

SEQ ID NO: 1484 - DNA, 385 bp, Homo sapiens
caagcaagatgtgagtaaagatgacatttctgaagtctcattaaaccgtgatcatatctcagtttatggctgacatcctatatttaaaattgcttgtttgatgcctgcactcctaaagagtaagcttcctgagggtgatgacatatttccaccttagtgttgctcttacaggaatcctcagcctgttttccaccaccaactaatgacaggtaataactctcccatgtaacatactcaaatgggaaaacatagggcaataaaccttttcttctaagtatattggaatgtaaataagtgagaatgctttcttttgcaggtttttttttttaattcttcatggcaaaatagttttgggaattctttgtaaaaaaaaattttaagccct

SEQ ID NO: 1485 - DNA, 287 bp, Homo sapiens
ctatcttaagaaatactgcagtgtacttggagaccatggttggtaaacactgccctatgacttattagagcgcctagtgagtaaaaaccttccatttcttcataaaatgaatgaaatgggtgttttctataggcaagatataggaacttatgtggttattgagtcactaaatctgaattttgtgttaaaataaggcctctgcttacctgtctagtcccattgtccataaattcctttccaatcctttttaatcatttgttcattaattgatctctcacattttttaa

SEQ ID NO: 1486 - DNA, 2943 bp, Homo sapiens
aatattttaacacaaaattctgtatgagaacatcatacagatccctcaatgtcaagctgttcaaagtcaaatgagtgtttgttataggcaagatataggatcttatgtggctagtgagtcattaaatctgaattttgtgttaaaataaggaaatctggaggatacactctctaatttgatatggaattattgaaatctaaggtggctgtttgcattacaccattctgttagaatgctctgattctcagatagttcattatttacttttccatatttatcctctccttaaaggttagagctagggagggaagctattgcctaccttgtaccatgttaggggtctccgttaaaactctctccctaactatattcttgtatgttaattcatggagttcgcagtaacagtttcaatgttttcccatatgtttaaatattatatatgcaattcatattcaccacacacagctgttattatgtgttctttagcataaattaatagctaatatttaaatgaaggtttttggacatggaatggggaaaaaagatgaaagggagagagaaagcatgtagaaacagagaatctgagagaagtgcggttgaaaacaggaaaagtgcagtataggggagtgaaaagactgaactctgaaacctgacatttcccctgcagtagaataaaggtgaatgatactttggtaccctgaagtaattaaactgactcttcaaacactagacaaccctctgcctatgactttgttttttccattttaactctttaagatagtccaagcaaatatttcatcacttctctagggacttccgctgaaaatttcagaacgtcgctctgtacgcagagtcctgggccctttctagtactcagctcaaggagtccaggctgtggaaaggtaggataagcctttacctaaagctgggagtggttttccctctgggatgagtcacctccaggataaaattcctaaggggttatttacaacaagtcagtgaacaggtttttcctttcactgacttccatcaccttaggccagagtttcatgtcaagtctgtgtatcagcagcataatcacatgcacataggtaatgctgagtgccaagcaggcttagggtaatcaaacctgcactgggaattcaaagagctaatataaaagaggtaattcctggcactctcaaaggtcttggatttaacagggatatgatccaatagagaaaaggaaacaaattaacaataaagtggcagcatatggtgaatacaaaatgagcaaagcaaacattatgacagtaagaggttaagaggtggtgagtggagatgagtcttggtagttttggttccagaactctttttttttttttaacgggtgcatttaaatgtatacaccattctgagagttggaaaaatgttgaatattccacaggggaacactttttttttcccatccaaatcaaaatttatttcaagaaactctcatatgcctccatcagtttagaatttggtcaaataaaattttgcttaaaatcagtgggccaaaaactaagatatagaaccatctgtatacagaattctattataacaggatgtgacaggcaatcatatggaggtgggagagcctggccagtggacttaagggttaattaaccatatttcgatttgaagcttggaagtaacctgatttttccagccattgtgaaggcatgtatattagatagctttgtaaatgatgcatttcatatgtaaagaaagtgagctttttatttttgactaattgggaggatcaggacatgtatttattggggactcccagaaagaagatgaacaaaaggcatgcccagtgacttggcaagagctctaaagaaagcaagaacgagtgtcgtctcaatttaaacatgctgagacaagaggaggaggccaagaatgttgactttcaagtgaaaccgagccagaaagcttcagaaatataaataaaataaacactgccttgaaggaacttgatatggatgaaagcaaatgttttctaattatttcaaaatggtcatgaagttgccttttagagaatgtagaggaataccttatcttgaggtaaaagctttccagctggtggtcataaggagatggtcttaagacatgggatatcaacagaggctcacagaatgggcatttttgttgcacttagtttaggcagcacataccgttcagctgtccgccttcctctctgtaatcgactccactccactctgcacttgccagacagacacgtcagttttgacagcaggtgccctgctctgtatgcaaaagacatccatgagtattaactaagtttgcaagaggaattaggatctgtaataaacgctttagcaaagaggcttttgggaataaaaatgtttcttcaggcaaaattctcataaactagacatcatctttgatttacagtttatagtattttcgtcactctatccaatatccccagcttgagggctgctgctccatgtggcatgattgactgcccaaggtgggagggtagttctgtgcactgaagttaagtcaactgaattagaaagtgaggaaaacataaaacaagcaaaactgtagcatttttgtggtctttttacttttttttttttggcttttttgtagttaaaaaaaatgtttatgtattactccatttaccatgcaggaaaccatttcaaaaatttgacagctgttttagaaaaaagcgttctccagaatctcttttgataataggcacaagatggagaccacaaccacaaccaactaggatacttggtactacgggatatcagagattcctttacctagagctgtcaaacttggaaaggaggccccttcaatacagatggaagatgaatctttcagttccctgaactctccttcagattttaagggtaaacaaagaaggggagaaaatgagataca

SEQ ID NO: 1487 - DNA, 2009 bp, Homo sapiens
gtaatttaacggcatagggtataaaaagagctcaatatcttataaatctacaagagggattataatcattagttaacaaatatataaaaggataagaaagaaatgagtagtttacataaaattttaccttttttgagccatgtttattttcaacatataagactatcagaatgattaccttaaaggtagcagaatattattctacagaattatataaacatatatagaaatagttggaaaacatatttaaagctatcactttggcaaataagtgcacgggtatgcatgagttgtaagttcctttttgctcatttattcaaagagacaaagatggttaaaagcatctctgagcatattttacactgagaattctaatgttagtgctttaaacaatttaaaagctaatatctagtttatgagtaggtttcaaaataataatctccttgtccctcttttccatacctcaaaagttacttatatttggctggaaggcatggaaaaatacatggttattgccaagatgtccttgtatatctgtgttataagcaatactggaaaaaagagagggaaaggtagaaaatgtgctgaaaacagtagtattctgaaaaattaaaggttcttcagagaaatcaataaatggtaggaggagataatcaggcagtacttgggaactttgagaagtataattcaatagcgtcagttaatgcagatggtcagaataaaatggttccataagggaattgcttaagctagcccttcccagcacactaaagactgaaaaatttttatggtggctatgcaccaagtttggaaaaggtttatgtgtctttagtatgtatattggttccagatcatcagctctgtttctagctttgagttttgtcatctgaaagaaatgttcatgaattcctgggaaaatgtctgctctcaggaaatctgggttttccatgaagtagatataccaataccatgaccaaaacttaatctctatgtcttcagaggacactgaatgaggctatttttaaccttctttttttaaaattgcacttgaaatgatcaaatctgagacactgaatattcacattcaacaattactatttgacaacttcatttgtttttccttctcttaactacattatatcttttgtctcaatgggtcacaagtattctctattttaatgaaaagcttgatgttatcaagaaaaaacaacaacatattttgaagcaaatctgagcaaattaaatgtcattcaacacaaaatttaacaccacagtttcacaaaaaaaaatgtataaagctaaaattaacgaaactaagtaataaaatctgggtagaggaaaaaagacaaaataactttacttttcactttccgtctcacatcctacaataatgacccaaatggatgctcttgagatttttcccattgactcattttggtgtgagactgtgcagaggatatgcaagaaataagagatgtcagataaagaagataaagcctagtaaggtaggtgagtttgagtgggcccttgggctttagtgtttagacttagagagtatgtgaacctttgggaacaaatgcacatattcatctattagcctaagggaaatagtctctaagcaacttattttcaaatcattttctaaagctattgttcttatggcagcggggtggggggtgttaaaaataacagcaagaaagccttgctagatcatatggatgcttcatactcctctgcccttatctttgtggtcttcctatcagcagaaactatggggaatcatcccttactgcagcacacactgagactgaaaaacatgattgtgtgctcacggagattggtttctctgtttcttcctgtaagtttcatgatacaaccaggagagtaaaggtatagcataatgagggttataaattataatataaagaggatatatataaatttgaaaaacctgcaagagttttgcttttatatctggagttatatttgggttaaccctgatccctttc

SEQ ID NO: 1488 - DNA, 937 bp, Homo sapiens
tgtttacctatatatgtgggcttgctgtacagatcattttgatccctttcaatttcttttttctccttcccaccaatgactcctgaataacctccatgatttagcaaataaaaaaaattcatactttgaagatgattgtttaccccttcttccacaacaacaacaaacacacacacacacaccgtcaatctcaggtcttttcaagaatatttgcaaagttatggaactttcttctcttagagtccaagttgatccctaaaataaagacggacagagtcaaggatacaattctagtctttccgagctggcttttggcctactgtgcagcagctgactctgcgaactcggcatcagtaagggaggcgctctccctatttgtattgtgtgggtgtgttaatctaccacccatgtcaaattgcctcagcactaagtgtgtttgaaaggttcagcttgtgaggtggctgaggatttgggggaagggtagaaaaagcttggcttttcttatctcattcaaattggtttgtccatctctgctaccatgtgtctcacaaaaatcaagatgggtgacctcctgggggacttttagtacattcccctctgtcagttgaggattatatcctacaatctgtcccctagcgctttatacacacccatttaaaataactccagtaacaggatctttaattgactcaggggatggtggggggtgtcccagtatgattgtcgttttggttcaaaggagaagaatgaagttgattctgtgccttgtgtccgagtaacaatatgtgaaaagattcatttagttcttaatccttatggaggatctgaaaggagctgatcgtttaacagccacacagtgttctgctttcgagctgtttttcttatttatgtcttggttgttaaagctttaactgttccctttattgttcagtaaagg

SEQ ID NO: 1489 - DNA, 516 bp, Homo sapiens
ttggtattagcaattcacaaagcaaagacaccacacttaaaaatgaaatctactaaagtcttgcaggaggtaaaagtttggtttggaatatttcatgagtcgttagagaacagagcctccggcatgataactgctttcttgtggggaaatatggaacaatgtaactaggcaaaggaaagcatctactttgagtaaactgatgcaaatgaaaagagcatctgactttaccccagctggatctggtccagccatactgccttgcatagacacaaatgagttttggaacaggtatgagattgcgttggtctaggtatttatagcaaaaatagtggacagcttggcatttccataattaaacgttggggggtggggagacacagataagggttttctctcaatttgcattttccaccacatcttcagcagtgaatcaaaatgagaatattttattacaaattggaggagcaggaagtaaagggattaggcaggctagtaactataagaaacaaaatgatt

SEQ ID NO: 1490 - DNA, 1189 bp, Homo sapiens
gattattatgtctctacaaacaatacttgcatatctccatctgtccttgccaggtcatgttgttgtttatatcatttggtaaactagagagagcaagctaaacaaagttccccaaagtttcatggatggttaaatgtaggggtggaataaaagtatactaatagataggtttcctaatttcctctggagtggtgagtggcttacctactcatattaacgtgacctcaaagtttagtgcaatgtgaaacacatattgagaaacccagtttggctgggatatggatttttcttgccatattggatcatgattccagatatgtgcatatgaatacatcctgatgcagagcagtccaggaaggtaaatatttgaaacaaagcaaacagaaggggtatattttgttaaaataacacaaggtccaataagagaagggtcatagtccaaagcacacacacataaacaacaccagaatcactaaaagaacaagaaataacatctagtatctacttaaatcctgatctggaatttttctctttttttccccatcttttccttttttatatttttgcaagaatcaaaggatttggatttagtattgtaagatgaaatttcaaaggaaattggccatctaggaagaaaatatttacatatgaatatggcccttaagactaaatgaaatgacttgaaaataaatcatcaggtgaagaaattctaagttattattgaagtaatttgtggagagacagtttagaaaggagcccatgctgagctataacccaccataagagtctccagctttactgtataactaaatatttagccaaaaacaaaaacagagaactacaagctcttcatagcctttagtgaacaactaaatggccacttcattctttcccacagtaagatttggtaatttaaccaatactacaaaaatcaacagtgtatttttctctagtagtaagggctattatcacagagtataatatagagagaaagtaattcaaatatggtatcttgcctatcttatctcatgagtcacctcagttagtgttccagggtccaaggccagccagacaagagtgtagtaagaggacggcttttactgtgcagtgcctaaaggagactctttgtagtaaagcatcttcttcaatgtgttgggtaccccaagtttatggcccctctctgggataa

SEQ ID NO: 1491 - DNA, 1183 bp, Homo sapiens
cctcgataattctttaagacgaaaatattcctgagaatcattgttcttctttccctagcactatatgaaagagtttttcatctttttttccaagtcagaaaaaattaggatgaaataactggttttgtagagattcattctaaaatcagtagagatcaagagacgaaggagaagagtagggacaagaaaggtctaacaatatagagtgcaaaatttcctccacttcactatctttgccttagagttctggccaggtcttttggttgtcaacaaaaatttgggtagtgtcttcccaaaggacagttctaatatttaatttacccaaaaatactgtcatatgtgtaacccatttttgatgggcagtgaataaaagatttccttcatggcagcccttcaactgtccagatcactttgacaagcaggccaaagtcacctttatttttccttttagaaatgccataaacaaattcttaaacatatgcaaattagttatttaaaaccatatccttcagcattcatttccctgtgcatgctgatagtgctccacccaaatatgctctgtacacactatgtgatacaatttccagcaactctgagctttatagacatttagaattgaatttttaaatgatgcatttgtttttcttcaaactagaataacattgactttggctcagtttgatcttactctcaaatcttaagtccctaaccatgtacctttccagagccatcactagtttctaaaaatgtctttcatgttaatgaaatcataaaatagattttttaatttccctaaaactaaagctctatctccttataactttacatggccccttttatcatgcattgcacacagtaggttttaaatatatttgttgatttgtggatttaatatcagttgatagcataataacaacaataataatattacagtatttaggtagaaagtcttctttgtggctctgactaaagcaatttcattattctttaggttagttaatgccttctagtgaaaccaatgaagagaggtaagtcaagcattagcaggaaaatgattaattagttttcattaccttttgaagatgcaaagggatgtatcaacataattccacaactaatagaaacttgtaagcaaggaagcttcaagatgtaaaagtatttatcaacataattccacaactaa

SEQ ID NO: 1492 - DNA, 851 bp, Homo sapiens
gtgtggtttagagctgtgcaaacacacatagcaggtgcagggagactcaggagccatgaacaagcagctgccatgagcactactgctgggtaccagagagggaccagccttctttcctcatttgaaatgcgggaaagggcaagagcgcatactttacaggggacaggcaaggtttgaaggagaccagaccagagcaggatttgtctgtgtgagatgtgtgtccccagaagggcagtctgcactgcctggcattccatcccaggagtctcactgccttaagatgcttgcaatcctcccctgttaggctctacataaaactgtgtaacttttttctgtcctgcacatgctggtttcctctactgggcatccctcatgtactcttcagccttcacctctgctggaatttctttcagaaatctctgagctgagatatgattggtactgactcctccaccagcttaggagtggccatgagggctgacacccatcctggtatcacactaccttggcctgtacagggttaggatccaatcagaggcaaggatatttgctagggccttggagaaaaagaagtttgtcttgtgggagaccttcaagggcaaacatcatccttttctctgaatggtagggcatgagaatacaaggtctggatgtgagggctgagatgatccaaggtccaccaagtgcagtccaccaggccggcactgcagaaggcagaccacaaaagtagagagaaactgagccattcatttcactgccgatccattcactggatcctgcccctggcatctgctctcagcttttaaaattggagctgatacatttcccatatcatttagacaagtttcagg

SEQ ID NO: 1493 - DNA, 245 bp, Homo sapiens
ctcatgtcatagacattaaattatatatcgatgttcaatttgcattttcataaagtagtgaggttaactcttaattttacctcttcttgaccacatggcacaggaaagcatctcaaagtccttaccaggataactctgtggactgggtgattgatgcaccccaatgcgagcctagagcttgcattgtgctcattctatggaaaaacagtcaatctaaagagcatggcagagtgggctatggagac

SEQ ID NO: 1494 - DNA, 169 bp, Homo sapiens
gagggacagaccacagcagctgtctgaagtctcacccaaagctacaaggctatttgtaccctggccttcacagttatttggaaaattagagtcctttttcgcctaagtttatttaaattcaatttccattcttggtgaccaaaagcctcccaacatatttcttaagttc

SEQ ID NO: 1495 - DNA, 3604 bp, Homo sapiens
gatatgctgcaaagaataggactaactggaccagggatattcagatttttagcaaccttgctgagaatttttaattgttttccaaaagagtaatgtcaatatatcctgccaccaaaaaaacaaacaaaaaaaaaactatgaatttaccaacagcagcataaatctaccattatcactcctcttgtattatttggttaaaaggtggtattaatttgtacctgcattttgttttgttttttagctttcaaacttaatatgtttaatcaatttgtgtgaactctctgttcattaattatgatcaactttctattggagtgctggtttttttcttgccatttttcagtgagaatacctattaattttctgtcatacttaaaccatttctgtttggttttttttgaattttatttctattaggtatattatacttgtttggtagaagtctcttatttttatgtttcatatctgttgtttcctttaagatttcgtatattggcccaaaattttggaatcataaaaaccttctgatatacactttacttctctttacttctatattcatttccaggatttgtccatgtcatttatttcttcaaatactcacgtcttagatttatttatctattttgtttttgtgtgttttctatttttttcttttatcacatttttaaggtggcctcagttgccagatacagaatctcaattcaaatcagcatgaacaacacttgatgatttatttaaaagacatttgggtagttcacagattcgaaggccaagatgaagagtgacgagggtggaggaggcctaagaggggaaaactgccttcctctctttttctctcctaactccaggagctcagactattattttttccattggcctaaattttgccctgctgaagagaacaggacagctcaggcctgaagttctgcagctccatcactcaaggcaatgatgagccctcttccagaagcacccagtaaagtccagggaagggcccaactggcccagcttgggacccctgctggcccagcagatggaatcctataacaactggtgagtgttgcctctagaagacacttcttcattctcacctagtgagaaggcactaaaactcaacattggttttgagctcttcatggtacaaagcctcctagaagtctgaaccaggcaaaaggctgacctccaaagtcaggcagtggtctcatcattaagaggtgctgggaagcttcctgatgaccccccttcctgccatgccctgtgttctcccggaaatgaccgtgagcacctgctactgctggagagcagggatttcccaggctgctgtaggacgcaggctcccaaggaatctcacatctaccattcatctttggaaagagattctctaagtcaggactccttggttttatttgaccaaattgaaaagcttttggatcgagctttcctttgttattataacagcagtaggaagaccaagaaagcagtattctttacagaatactctactttgcctgaatatcatggtctgctcatgctatttactacatagtaatttaacaaatttcctgggctcccttcttaaataagtacgcttttttagtaattcactcctcattggataccacattgcaatacctaatgataacttttaagacacattctgggaggggagggtaacaggcttctctctgctctcttatatacttctgtttctccagttcatgttggttaattttatttgcatcatttggagctttgattttagtcagcattattaataatttactctttgacttaatggggctgctgaggggatgagacaggtctgattgaagcagtgtgagctccctggtatggacagctatgggcatcgtgtgtgttgccaagtgcattacagagtaataaatgtataacgagttgggccgtctgggtgtgctaaaaatgaactctgagttaagtaagagaagcatttccattgtgctgcctgtgctactaaggagccctttctgtgaactgtcctgagctacagacttgttcagaatccacttctgagaatgggtgcagtgtgtttaaatgactagcctttgtgcctgtaaaccctgaattattttagaagttggttctaattatttagaactgtgtctaaataagttactttactcaggagagatctgtatccctgttcctaaccatgcaccatggaacaggtctttgggtgctactcaaaatctctcctttcatttatttagttaggcgtggtctaaactgcaccagtatagcttgtggatgtgaaatggttaaacagtaaaacctcaaatgtgtgcagctgtgggttgggagagctggagtcttcaccagctggacacagacaatgtgggagagagaaccacattcacaatgggggagaatttgttgtctatactctagacaagtctggtttccctcacactaaatccagagtagtcttcagattggagggagaaaactcatgtccaggtaacaatacagaatattctagaaagactaagctagaggaaagactctcccttacattcagtggcaaccaaacagatttaaacacaggggtgggtgactgtccttaagatataagtgtcaatcagttgcagagagaggctgagaatcttttcagttggggtgaaaaactccagtcaagaaacagcccctttgtcatggacaaggtgtggagcaggaacaggggtgctccaaagggactcaacaatgatgaagacctgagaattccagacaatgacaaaaaataggaccaacagcagtccctccactgcactcagctgagagcttcaccagcagagggggagtgaaggctaatgtcagacacattgagcaattaactagttatttttatacacataatcataagaacccctgagttacagtcatctattgcaatccaaatcggtagaccatcaccagaaactcagtctgcatggagtgccctgatgtcatacttaatgacaactttttagacatatttttttaaatcaagcttttctctattattttaagaagaataaggagaccaggaaagcaggtttctttgcagaattttgcctgaaagtcactgtctgtgctatttaatttattacagaaatatattacaggatttccaaatttttaaaaaggtgaagcagaattagctttggattaaattttctgctatttctatatacttctaggatttcattgtattcaacacagtacttcaccagcaggtaggaaggaaagggacatttagtccagccctctctgctctccgctcttgactaactccatccgttagagtgggaatgggtcgtgtcttcaatgcagcttgctcaggaggaagtgggcaggaagatcagtcaccattgcagctatcccctcagcagcaaggcaggagttctcctctggccacaaaccccgtggacactgaggaacggcagccctcttcaccgtgtggggccacagtgatgagatcaacccatgggcccctcctgccgattctgccacaaatgggcccaagtggcagcctgtgagtgccaaggacagaattagctaccatcctggaatagggaccctatctttg

SEQ ID NO: 1496 - DNA, 304 bp, Homo sapiens
aaggaagctccagatcctgctcttgaaatcgcacacatcatgttcacaaaatcttgggcatgtacagcaaggatagggaggagatctaagcagctccatcttggaaggacgatggggtcctgaaagggatttctgaaacttactcttctcatcctgcagagcaaagtttaaacatttgtctgaagaaacagagaaaaaaagaacagctgtgcagaataaacccattaagttcttacagaacaacctatttaattaagtgcttgacatgtgccaggtatcattctaattactctacacacctatt

SEQ ID NO: 1497 - DNA, 209 bp, Homo sapiens
cttatcccaggtagagaagcagcaaatgtcaggcacagcagcaggactggaggtgtctgtttcagtaagaacccatccctattaccagatattcaaacagggagacagttgtagtaccttccactgggctgtggggttgaggggagagcttataatggaaaaggaaaagtaaattcataccagacgtgggatttcaagtcttagcttca

SEQ ID NO: 1498 - DNA, 2305 bp, Homo sapiens
aatttggtgagtagcaaatactctcacttctatagcccaggtcacgccttcctggatggagatttactgtgaagccggatcaggcaacactccttcctcaagtgtccccagcgtacctgtggcacctggaaagctgccgctaacagcttctgctgaacacgcagacacagaggctgttcagaccacagtgatgtgaccaggtaagatctgaggctctttctggttcaaacagtttatgctccaggaatcaagattatcataattacggtaattatccataattatgatataatccataatccataattggtataatccatgtggtataatccataattatcctcttgtcattatcattgacaagttaatcaataatcacagaataaaaatatattgacattggaaaattagttgaagactatcttgggcaaacttcctttgcctttgatgtaacatattagcaggaaactaataaagtgaatgcaatacacttgttgaaatacaaggaaaaatgtgtcattactcaattccaataaagtccagaaataaaaagaaataataacttgtgaaaaaactagtagtgatgttggggaaaggagaatcttacttgtttaatgtcaccttgtaagactgaaatttttacaaaatgcagtagaagattcaaaattttcagaatgtctaaacagaaaactttattttagtattttctgtctaaaactaaaaaaaaaaaaagttttagacaggaaaaaagtacattgttgctgtccagatagtgacaaatggtgtcaaatgttaatacctagcagctactaccactacatgtaaacctgctttaatagtcactatggaagattatgtaagtaaagtgattgggagaagagaaagaaaaaaaagaggaagggaaggtgaggcaagagatgatatgtttttctagtctgattttacaatggctcaattactctcttttacacttcatttactctgtgcttctaaatttatacagctcacgaatgggccccacctcccctggaatattgcccatcagactccatatcttaaaacaccacacctctggcagagctcctgaccttctttagtggttgagctgattgatctcattaattggcaaaaatctatttatttcttctctaataaatacttcctattaattcgattaatctctttcctagaacatatgctaaatttagagaagattcttcaaccgcagaggtaccatgatgcaggaatatttctgtaatagcaaattcattctttccagaacattagcccagaatttttaataaccttaggagctatcagatttgcacaccacgacaatggctaagtctccaacccaatttatcctcttactcagatacccactttaactaattctcgtgctagaaatgtatccattttaaattgggaatttagaggtctccttgatagaaagcagtaaaatagtacgctctaatttcaggcatgtctaatggaaatcttattcctaaactgttattaaattactgggatattgtgcttgtggtttatgtgacccgttacatatggcaacatctctatttaaatgtcatcttgggccatcttttcaaagacacatcaaaaaaataacaagagctatcgctaataaagaaactcatttcttaacagttctcaatcaaataaattctttccttattggacggtcaacaaattaaacaatcaacaaatgttcattaagcatcacaggggcaggagggtctatatatactccaatcaactcaccctggccctcctggcagagatggactgaaaaagaactttacacttcctcttcctttcccttctcatccctttgtacatccaatccttggctcccgcattatctaattatgttcaataaccatacagaaaacgcagctcctgagttttgcagggaaaaaagaaaacatactaaatttgcttataacagaattccatgtaagagaaatttgcatctgggcagcgactgggtagtaacagaagttttagcaaaactgaaggacccactactatgggggattaaggggcacacagaaagtctttggtgttttggaaccaacctgtattccagaagaagaatcagcctcacagaatgaatactcacccctctcccatctcaccctctgccgtctgattcccaacctttccttttctcttgcacattagtttagctgtctcctttctgggctaatctttgaccacaccaatgtccttggcatcaaatcttcacatgggtttcttgttttgttaaacaaagacactttctttg

SEQ ID NO: 1499 - DNA, 200 bp, Homo sapiens
atatagaattgtatgtttgaagttcaaaattgttcatgagattataattttttttaactactgagtagacacaataatataaaatatacataaagtataatgattagtcatgcaacagtcatgaacttagcacttgagaaaatactcatcatccttactctgaagtcctggggatgtctctaatcttattctcttctgta

SEQ ID NO: 1500 - DNA, 129 bp, Homo sapiens
gtagatttttttctaaagcaaatgtttggtagttcacaattttatctgtgataattttattttagagaaatggactgagaaaagatttaattttcatttttttcctgtgtggataacaaactagtcata

SEQ ID NO: 1501 - DNA, 37 bp, Homo sapiens
ctttgttgttggttttttgtttgtttttgtttgttat

SEQ ID NO: 1502 - DNA, 377 bp, Homo sapiens
ccacagctgcaactcaacaaagactggccagtgccttcgatttcatccagatggtagttttcctgaagctgaaattcatttctatattggcacagccccacctctctcctcccaggatctcccatcaccagctttggatgtaactagaaggagtttatcctcaggctttggtgaaatcagagaaagtcagaggagaaaactgctatacttgactacgtctttgccaggatgaagatgaccagggaatattcttgtaccatatctgcccatcactgaatccagtccatgtgggattagactgtagaaattaagagttgtgtctattacatattctatgtttttgggctctatttctggttgtaagaatattctaaggt

SEQ ID NO: 1503 - DNA, 631 bp, Homo sapiens
agacaaggcagcatgttctgctctgatgttgagtgaaaaagaagagagagggagagaattttcaacagaccatatctgtgaagtggaagcaagagaattattttccttagaacagacctttcttctccccttcccctcaagcctgtctgaaactcctctgctaactggcttgagcacttggaatattccagatgtaagaaacgcagacgggcaagagcaccagccaccctcccacagctgcagcccagatcttgtgatttccgccaggctcaagcttggcctcttggtttctccttgtcccgtgtgctgattgtgggaaaattctgcgtgggacacgtcttttcttcagcactctgggagtttgccactccggcctccccctcccgaggacagcagcagacgtgcacatctgcttaggggcagggctggcagttcccagactactcctggaagctgcagtagaagatacagtttactctgagcttccgtcttgtgcacctctgaagtccccaaggatagggccttccagaacagagaaagcgtggcatgctctgctcccaaattccttgggagaagaggtttcattgtccttggtttcttcggcttgtaaaacttttctttcctttttctt

SEQ ID NO: 1504 - DNA, 2350 bp, Homo sapiens
aaaacttttattctctggtgaggttgtttgaggctctccatgcaatctcccgaaaaagagaccgaggcccacacagcatgagaggagagaaatgagtacaagctaaacgcagtctcttctgatggcctctctttcccagaaataagaggttatagagaaaacacaaatggaatctaaatctggtaagatttgcagaacctcaaggtttcgctgggtcaggaacagggtaaaaatagtctctgaggatgaatcctggccaggaaaatagagacaagtgaaggacagggaaatacattgtaaaatttcactttttccagcttcctatttggtttcactctgaattttctctgaatcatttatttctcacaccgccttcatagcactacaaggagccagctacagtaccagaatccaggagatggaggcatgagggcttttcaaatgtccagtggtaaaaggtatagtaaaaatagatcccagaagtaggcaacatacccacaaagctggccagacaaagtcctgggatgcaggaacccagccactcagcacaaaagacagccatggagctcgcagtgcagacgcaagggccccgagaagaggaacagccaaaggtcacctcgtttttggaatgcttccagctatcccaaacaagcaaatgacgatcacatttctgaaaatcctcaccacgggggcattcctgcttcccctgacggctggttcctttccactggccagttgtttcagacacttatgtcaattttcctgggggcaagcctgttccattttcatctagttcctcattctctccagagggcgttattatgtgctagggtcatagagccaaatagatggacttgaagataccattcctctgccattatggtcataatcgtctttttataaaggactgcctaaagaaattcagccgtgaaggtcagcaatagcaacaataactcacagtttaaccatttgcactttggataattagtcaggaggagagtaacggagacccattcagctacctaaagtaaaaatttgcgtttggttttattttctatgtttctttccagaatgaggtgagtcccatggtgtccaggggcagagaggcacccgaggcctttcagaagttagaaggagaaacaagaaagtcccagtgagctcagcaggaacctcggcccctctcctgcctccagcaggccttaacagagtcttctctcttcctctctagggcctctcattcctataactctgcaaaggcatgtgcctgttgtgttatacatatgaacacatatgaaagcccaaacctctgtttcacagccttccttggctatcaatcagcatgttaggtgccaatgccaaattcctgggggtgaaaatctaactgacccatttggagttagggggctgccccaggtccaataaacaatgccaagaaggtggggggctacagggtgagatagagatacctgcccacttttttagtgagacctatgtagacttccaaaacctatccattacagagactggctaagaactttcacagacttaaagtagttaataagctttgtccgtcctaccctgtataagaaaatggcagctctagaaccttggaggagagattacatgagcacttatattcttccttggcactctttactttggctaggattaagcctcaatgtgtgagaaacttttgagggggcctgagccctccctgggtgtggtcaatggtagcccacatcctgtccgctgaacagatcagtgtgttaatgggccatgggttagttcacgcagggatcagttagtagtaggtgggtcccctgcacaggtttgtccccagtactaaacccattcccactatgctgctggccacaggaaagcatgagccagtcagtttggacagccagcctccatctgtcacttgtcagaaggaagtcacaaagcccaagcactctgtatcatctttgtaaagatgaaataaagaactgaattattacttggaggatagaagacaggtagaatacaaagccataatgatgtccacatttcaataatctcttaattcaccaaatgatttataaagaagcccctgactagcatacatctcctcctctgcatagcatttatcaccctgagtggaatttgatctcatttctgtcttcctcagtaaatactggtgttcttgaatgaaagcagcatattgtagcctcttgtaggcttggggcccagcccaggatttggcatgtcgctataaacagttgacagtggatggatgaagaaatgatgaatggagggaaacatttagggattaaaagtctgaaagaaaacaggaagggactgaaaggaaagc

SEQ ID NO: 1505 - DNA, 404 bp, Homo sapiens
tgttcagtagcaagtgtaacaatcccagtgagcacaggggtcatgcatcctgtgatatggtgccgcacacaaatgagtgcaacctcctggaccaaacctcctggaccaacacggacctgggactgggcttcactcaagaagcaaatgagcttgacccaaggctaaaagttctcagtgtcatggtcttcagggaaatccttctttgcctcctctttgtgtgccctttccctccactcaggcagcagtgctcttctggcatcgccccaaatcaaaagggaagtcactcccactagccatttgctcttattgatggattacactgcagtgtgaatatgcttcatcaactttagcccagtggttcttaaccatttttggcaggagaaaagagaagttggctcggtgca

SEQ ID NO: 1506 - DNA, 507 bp, Homo sapiens
cccccaccaccctttaaatgcaccaactcagtttcagggcttcccaacttgagatctgttatcagggtctactagactgtattatttggctcttttttagttttaagcttctgatctctaattggggaagtctgttacttagaggattatcaagcaccaataaccagatagggaggaagaaatttctctggtcagaatcagacttcaaagtgcacaaatggaaccctgttagacttctgggtaactgggaagcagtaagatagcagggtgacataggagcactactcctgtcctctgggatctcactggccctttgtgcctctctttctctctcacacacactggccactggatggaagtcccagaacattaaagcccctgggaagccgccctccattaatgattggcatgtgtcaaccggttagcagccttgcttcctaattttctagaattatctacctttggccttccaggacaaactatcacatacataatttttaatagatc

SEQ ID NO: 1507 - DNA, 335 bp, Homo sapiens
ttcttgggtgaggtatctgtacttccatgctgtttattctactggtaatgaggtttcttacagcaaatgctataaccttgtttctcatgaaatcgttgtaacccttccttgttggcttttattttagatcaattttctccaaaactaaaattttgtccttattttacaaaatgaaaaccaaaattaatttaaatatttggtttgtcactagcaatccagttgattacttatcttatagcttatgaattgaaaccaccttatcatttttagaatcatccagaatctctttttaaagttggtgactatttttttatttcctctcttcaatgaagaag

SEQ ID NO: 1508 - DNA, 290 bp, Homo sapiens
atacatttcatttccccacatgaaggcttttaggttttaggtcacaatttttttaagaaaacaaaaaccataaaatatctgcactttcctaattttaccctaaagctccattttcactaaacagattaagcacatgcatttttttaacaacaacaaatctgaaaacagacattttaatttgaaatattttggggaaaatatttaaggaaatagtcgtagattataaaacatactgaggttactcttatcaaaacatttgactacttcaaaatgcagttaaaatgacatta

SEQ ID NO: 1509 - DNA, 681 bp, Homo sapiens
aaaagagacaataaatgcttcaaaggcatgatttaaattagttttactagttcattttatttcagaaatcggtgtttacattgtctaaaggtagaattaatccatgttttaagcttttgttctatacggggcagagagaatgttgtaatgtttctcaccttcaccctgtgttcttggagagtatttaatttggcttattggctgcaaatgtacattatttttctttttcaacttaatttgacctccacagttatgtgttatagcttggggttcaagatataggatagtttcatcataaatgcttttggaatcatatttatgagtttttctaaactttgtataagtctgacttgtagttactgttttacagtaagcccagtctttcaatttcccagtaaagttaatggctattaaaattgcatctaacatttttggactcagttatctcttagatttaattcaattttctaaacagcctttgcttattatgtattttcctttcccttcaaaaatgaatcaattattagtttccaacataattttgaccaaatttaagttcttattaacacttttttaattctatgaagcaagtcaagtgagttatctcaactacattttcataatgtacgtaggcttattgataatattaagtattactgcaatgattaatgttatatgtca

SEQ ID NO: 1510 - DNA, 41 bp, Homo sapiens
cccacaatccccccatcccctgccctgcccactggtgctta

SEQ ID NO: 1511 - DNA, 625 bp, Homo sapiens
cctataatacaattagtaataagtgataatgtagctcagtcagggaatatagaaaattattaagaagaaaatataaatcactcaagaacctcttacctgctggcaacgttaatagtttagtgaatagccttcaggtctatgtatgagagatatgtaaaatgcttaaaacaatcctgcaattttcattttcagtctactatgcatagtggatatcttttcatcttagaaaatagacataagtcatctactgatagctccaaaatattcatttgtgggaatatatcaaatactatttcatttgggatgagcattcagttttcaattcttccttctatgaacctcattctagtgaatgttaaacacacatatgttaaatgttaaatacatgtattttcatatacaattagttatctgtgcatgtatttcttgaggttatgaagtaaaaggcctcacgccttctatagtttgaattctattgatattgatatgcaatgctgacttccctctgatctgtcctaggaatcccaccaccagaccccaatctccatgacctaaagacaatcttttcattgtaaatttacaaattacagttgtatatatttatggggtacaaagtgagattatg

SEQ ID NO: 1512 - DNA, 110 bp, Homo sapiens
atgtaactcttctttcatattcattgcaaatattacctcaaaatatcattagtatctaataagggtctccttgtcatttttctttctttcctaaaaatactttatctctg

SEQ ID NO: 1513 - DNA, 708 bp, Homo sapiens
ggacccataatcacataccatgttcccaacttatccacctgtaatatgatggaaatttcaccaactcacacaaaaccgctttggatagcatatacccattttgaaacttcttaccattatccatactccttttcctggaccttctcctaaagttgtttggcctatttaatcagaaactatttcatccatctacttgtcataggttcttgaacatattttcataatgtttatcagattcactttttccacaaaggttttgttttcattcagatgttctccacacattattcactttctcttttctgtgtatcagataattgtaggcttttgaacctaaaggcaattgtaattcttattttcactgcctctcctcagttgcagctcaatatttccaatttaagtgatagtgtctgctgagatggcaagctcttcctgttaattttccatgttgtaggcatttacataggcatttggggaagttaagggttttccccaaagcatttcccacttaccacaactgtccacctcacagcagacttcaggatttcccccagatcaatacacttattttagtcccatattaactcatcttcattaaatctccctttgcctatgcagcaagcagcctgcccccagagtcccagtcttcaccaggtgtctctcctcttttactcaggaggactttcccaggaaaaccatgccactagc

SEQ ID NO: 1514 - DNA, 393 bp, Homo sapiens
cacataaaacttgtcagtgagggatctttatccctaggatgcttctgttttatttctttttcaggttaggagaatttgtgacttcttcactcctacccacacagtcctgaagtcaaaccatccaagtttgaccagagagggttagtcactataggttagcaggtgatggagctggtgattgtgtttgtgcatatctgagggtgtgataagccccagctggttttagcacagttagctctcagtgcttgagtccttctggaatggtatggcatataagccagggaggtcaggtccacttagagatgatggggcaagaacttttgaagcttttccctaaagctgttctcagttccataccagcctcccagatatatgttacccaggccaagctga

SEQ ID NO: 1515 - DNA, 1600 bp, Homo sapiens
accaaaccaaaccaaaccatctctggtaacactctctggctactgtgctttctactcaagcacacaaggccagtgttgactctccaaagcatcatgtgttacagcagagcctcaaacaacctcggtgggactaactgtcataatcaaattgactccaaaggatatggaacataactttctcaatctgggatctcattcgtcgcaattctagaatccctcatgatggacatcagggaaatggaatttagtatggccctgtgggataaactaaagtctactaaacaaaagggaatagtgagcctgggactaagaagaaaaatagacttcaaaggagaacagatgatgagctctggtgctcacaggaagccccaggacaaagtttcagtcccatcttacccttgaccggcctcagaccttaaagtagttggtcttttgtctgtaaaaagacaacaggattgggtccttaagtgaagaaataaatagtaagtagttctccaggttttctgcagttatgtctcatatttgacaatcttacactcaccgacttgacagtctgctttcactaatccatatgcatataaggtgtatattacccccatgtctacgagattctcacttagccaacgacatctgtctttgaactgtcacgaaatgctagaatgattctttttcttttgtggtgtcaattcctctttctgtcattattaaccttgttaaataccctcttccctccccttctgaaaggcatgaactgagtgctaagtttcaaacatacccccttaacacatccagatggggggaaaaaagcacatctagctatctacttaatcaaacatctactttcactccatcaacggggagtaggcccttttgtacatttaacaaattcaagcaatttagcaactgggttaaagtctatgtaaagtacttcaacaacatgggaaatgaagacactggtcttctgtcttagaattggttaatggaagacgtgaagtctcaaaacgcgcacaacagtgggttcttacggagctgcctaatgcactgctgggaaaaccttgagaagttttccatcacggggggaggggggttgacagtttttgcctttgctgtcagttccactgtgggaggctcctaaatttattatacctgggaaatgattctagtgcaaacccatcctgaaagaagccaagaagtgaggcatgcagaacatccttctacaggtattattggttcccaccccaagttacagaggccaagtcaaggcgactccatgggccatgaccatggggcactttatctaacttgatcaaggtggagcagagcaagaaattggtcctatttgccttgctacgtcaataagttttccaagccttaacttaaaaaaaaaatttacctcataaaacagaattgtcacagtggagtggtggtattttctaccagcaacaatgtctctataaaatgccctttctactgagtagtcaaaatgctcaatgccacctgttagaagctcacatgtcaaacagttttttgggtcatcaagaagcagctgtatttctttcttaaaaaaattaaaaataactctcctcaccttgggggactc

SEQ ID NO: 1516 - DNA, 1850 bp, Homo sapiens
aggagaagattggcaagcactttttgctgatgagctcaaaagctatgcaaatataaattattgagtactgcacatattgccacactgctacctgaggtgctgggagctttcactgaaatcaacaggagctccaggaatgcaaaagaaatatgtactgggagagatgggtccagagcattttggtggtgcttattgaagcacagtgttgtagtggaggggcaactgctaagtgtatgattatcgaccgctgcatttggatttgctctgagaactctgctatatcagatagtccggctcaaaggacatcaatcatttggtgcaacactctgtgtcttatgggcttaatggcctttgaatccagagggccaaaagccgccctctgaagtgagcaaagggctcttcaaaggctggaggagtacgaggaggatgaactgacttttgattcacaaataataaataacctaagagtaagataattaaagtagcatacaggttctgaccttcaaaggatcaataaacaaatgcatctcctgctctacactttagccattggagccaaatcccatggttctaccctcagtttagtccctcggcttaatcatcttttgattggccatggaatgtgtacctaactatagtcaacagtcttacaaacatatatacatcctgtatatctatttgtacaaagaattggatcttcatcctgcatattctcttttcaaaattagcctttgtttaccatctataaatcaagacaacattattccttctcccaaaatgcagggttattcaatacaacttgttggaaacaaaccggcttggctgaaaatgtttatgagctataatcatagaaaataaagggatattataatgagaagtcaatctttcagtttaattgcagaacactttttaagctacagaaaattgtgaatttgagctctgaagtggaaataaagttgccagtttcagactgcatatcacagaaaatgaattctttttcttcattagaaaaacatatctgcaagtaataagatattatgagtaaatattacaagaatacattgtactgggctgtgtgtagctacagaatgcattatatctttaaattatttctaaatcacaaatttagagaaagtcctgctcctggcattactaaattataatctgtcttcttatcctacagaaataaagaggtatcaactcacttaggataattgcctgatacaaccagaacaggattagggaaaattcattatggtattgcagtgttgtattttaaaagtattctctgcttcctttttgaaaaatggcttaaaaatgagcagaataatgcacatacaaggaaagtgtgaaataaattgtcaacttttagttgaaggaaggaaatttggaatattctgtgttgaagcctttactgctaagacagcattaaataggtgaagaagcaacacttctagtgcatgatcgcagagccccagacaggacagaagcatagggagggatgggggtctttcagctgtcaggagaggaaaacacagtccctctgcatattggaaaacaaatgtgccaactccttgacatgttacttaaacaaaaatatttttcctgtaagtaagataaacccttcaaaagtagcaccatgaaatggaactatctgctgaatatctgctcactgttctaggaactgtgaggaaacaaaatagaaaaaaaaccaaatctctcctttcaatgagagcaaacaacaaatgttaccaatgaaaaccagagagaaggcaggagaaaagctaacgctcgggtgggtcaaggtcgttccctttcatggagaacagacaatgacaactcaaccacaa

SEQ ID NO: 1517 - DNA, 346 bp, Homo sapiens
gagcagatattaatttttggagtaagggtacagagatgacattgcaaactgcttctggagaggccttcaaggaactgactgcggagggagacatgtctggagagctgcagcattttaggaaagaggggagaaaacagccaatgaatagcacaagagaaaagcatggcgagtggggtgtcctgaagatctacctcactgatatcggggttcaataaaatgttcgtgcattttttggtaaattttaaagtgctagataaatgctgacttactacctttgggaccagatggactttgctccatccattgagatcattctttccagctcttcttagattaaaaaaaaaat

SEQ ID NO: 1518 - DNA, 589 bp, Homo sapiens
ttgtttgtttatttaagaagagtgtttttctatcactttttctttttgaactaaggttgagatttttaaagtactttttttgttttttaagatagaatcacatagcttgtgatcaggttctcatgcttcagaatgctatggctgtgttttatttttccacttcctctaattagatgtttgaggtcatgtctccctgcaccactatcaccattctcagaccccattagtctcttctatccctgtcctcctgtcaccctcaactttgaaagcagtgtatccctgtccttttttttcaccctcgaactcgaaagcagtgcagtattgtctaaggaagcataatatgtagaaaggattagacacggtttaggggaaagtttggtgatgcatctgctctgagagtacagagaattggcttaaaagggcatcagagtaaaagaccagtttgcagaatgaattgtcttgtgcttgtgattgtctttcttgtggaaaaggccattttctcaagggacaacttgagtttagtcatcatttggaacaggtacagattcttacataaaactaatatacatgaaagcaacatttgttgagt

SEQ ID NO: 1519 - DNA, 2299 bp, Homo sapiens
ctttcttgcatgaattggtttattaaatatgaatgggggaagttcactagaaggctttttcctcaaaagaagcctaggaatcccttctctgcttgtaagtggacacattagtatgatctccatgtccatctataaattatctatagtatgatcaattctgaaattgggaaggacaaacttgggcaaatagctgctctttacagaaagtctaattggaaagagaatgactatgctctgtgccatgaagttttcaagagaaatgttgcaaggaatagaaatcttgatagatatgaattttgttttgaaaagctccgtatgagaaaatcttccacgagggacatcccttttaccaacttggcaaagactaaaaatacagagcatccaggatcaaagcgtattcgtgatgcgaagaactatcccctgacaatcaggctggaagaaggaggtatcctttaatcttttccctttgttttattactttttttttctgaggggaaaaattctcttttttattttctcttgctgactaactcttccctttagtcattttcatctcacgactcatggcaattttccctctttacattaagaatgaatataaacacaaatcacgtttgagtttctatttcagggccttgtttctctcctcaaatgttcagaggtaagcaacagaaagttggagtgagcatagcactaagacttcagcaggatcagaagtttccatcttccctctttgctctgtgcatgccagagttatggagaaaaatgtttcttgtggcaacaggaaagcagtttgaatcaatcaaagatcatttatagtttttataaactggagagaagaaataggcttgaacgatctttagattccagggaagttctataaagggaaccagaagtagttatttataaatgaaactcgaggtttttggtaaggggcttatgtgctagagattgcacagcttcattcaatgtgtcctagtttttaggacaaaagccaaaataaggggcggaggattattgcacatagcttcctgtctgggagtctaatatgggtgcacacattgatgccaaggttcgcttttgagttgttactttcaaaaaagcttcatttattaaaaaataaaatcatcattattatctcattacaatataggccctggatatgaaaaaaaattgattacctgatctttagttcccaactccattctatctctaattttgttgcttggggattattggtctatcaacactcttcctgaataatcaatctggttaatttagcctataaaccacttttccccttgtgtctggtgtaacatattgtttagtaatgtgcccagtaaagcagaaaaagtaactcccaggaatagaaaaggaaacggcactcagattttgaacttgagtatcttgcattttacccatctgctgggctgtgcggtaactcactttttatttattttgtttttagccatatgactaactctacctcattgtgctcagcagctgaacaaaatgcacagtgctatattctgaggcgcccactcattctttattgcttttatgacaaagctgtccctccacatgtctgctgtgccctctgacccaaggcgtttacttcaagtaaacatgccagatggtggagaaaagtgatgggtcaaagaacaatgctcgagggtcaggagtcaccaaatccttcttcacaaagcaaacttaaaagcaacaatttcaccaaatgctctggagtgctttcacagtggaaatggaggtgggaaaggtagaccttaattacatattttgctttcagggcctaatggttttaggtacagtgtctattggctaatttgaacgtaagcaatttatgagaaacgataagaaaacaaagaggacagatggatcactcttgtactcagcaaagagcagcaaggtgaatagtttgtgtgtgaatgagtattctaagctctggcccaaaaattacacaggtaatttagattccttatcttttctaggggctattgttgaaagttgaggcctaaaggatgccattgtctaaaatacactagaaccctaacaaggctctagtaacctccaaggaagcttttagatgagatcttccatttttttccttgtctagtatggtgctgcgtaaatccagatatatgagcatttgaggagttactgtaaatatcttaagcacgaggatgtgtctttttaatgttgctgttttcaaaagtaatttaagaaaatgttcattagccattttacaggctgtgtattttagaaagaacattagaaatagtag

SEQ ID NO: 1520 - DNA, 46 bp, Homo sapiens
tggcataacatgtctgtaaaatgcactggatttatacacagtatcc

SEQ ID NO: 1521 - DNA, 330 bp, Homo sapiens
gagggaaaaatttttgaatttttcctgttcagtgcattgaaacatatccatgttcctaaaactctttctgggttaagtactatcatatttgactttcaagataaagtgtctctcctaattgccaagcgtaagaacttattttttgtgtgtggtaaagtgaattctctagctgggatatggtataaaatagagttaaattggaattcctaatggagaggttatttatagggctgaatgtgtgtccttaataagttaccaagattctgtgatagatcacctgtgaagagattggcagtaatagttacttttcaagaattaccaaattaacat

SEQ ID NO: 1522 - DNA, 112 bp, Homo sapiens
cctccagttattggatgtcaactatgcacgagaaactttatgagctactttatgagatactttatatccatgcctaatttaatttttccaactttagccaaaacgacagcaa

SEQ ID NO: 1523 - DNA, 113 bp, Homo sapiens
atgattcctgataagggggtttcttgtctgtttaaggtggcaaaacagaggtgcaggctgattaactcagtaacttagatcctgccatctagtacagtggcagagctaagaca

SEQ ID NO: 1524 - DNA, 675 bp, Homo sapiens
tccacagtttatgctttgtcttttactgcctcaccaatgtcataaatttgagggttaggaatcatatgccaggaaaccccatggaaaattgttgtgtccacatggacttcaaaattccccctactccattcccgccctgagaaaaaccttcctctttctcagtcagggattaacctatttgattttcaaaaactctagggaaagatatttcatcacatcacattatgattatcattgttataagaattttattttccttagagactctaccaatataccctcctgctaagatgcagagcttttaagcaataggaaagaacagaaatgacttttaatgacatgacaacattgctgaagatataagtcccagaacttctctaacttcatgctgtctcccctagctacttacttgacactttctgaattactcataactgaaaaaatacactgtgttttaggcttggttattaacatcacattagaaataatttatttaaccagtttctatctgttgaattaacagaaataccagctctcctggagaatttccagagaatgattcgtgatcatattttcttgagaattgaagtggtataatgctgaacaagagaataattgctatatatacagataccctcttttctcaggacttgtttatgtgatgtccaggttcct

SEQ ID NO: 1525 - DNA, 106 bp, Homo sapiens
tactgtctgtgttgtgttacgtattttctctttcttaaatgcataggtttttagaagtctttttaactccttttcatctcttcactctgagtctggatttgatgac

SEQ ID NO: 1526 - DNA, 32 bp, Homo sapiens
caaatagctttcctctgagcctttgggtaacc

SEQ ID NO: 1527 - DNA, 642 bp, Homo sapiens
ataaaaacactttcagggaaagagattgtggaaaaggcaagtagaaaataaaatggaaagactcatgctgtattgacaattttcaactggtttagttatttaaacaaagcctcaatccaagcatactaaaccatttgatttttaaaaattacattattagttgtttgcctgaactcactacctgtttggtcaaaaagattggataaattgtgggtgtgtagataaaatacaagtatagtatgccaatcaacatcacacgttcatattgctggttcacattagatgctcaataaagcgcagctgtgacgtctcttgttcagtaatcatgggactgctcctgttgccaactttgcctgtagttcaccaaagtcaagttgcccacggtaagataatttttttttaagattattgttgataggttccaaaagtgtattaggtggttaaattcctcattgttaccaatggattagtgagtcaagcaataaacattaacttattaatgtcagtaacacttttactttcagtattcaatctagttttatttatgttttatcatctgtggcagtagttttcaaattaagagtatgtaaatattcaaaatattttgttctcagagtcggggaggtaatcaaaaaatatttt

SEQ ID NO: 1528 - DNA, 115 bp, Homo sapiens
gactaaagtctgtattaagttccttaacatctgggtggtcaatatggttgtaagtaataggtcttatgagaattatgcaattaagatagttataatggggacgggtgtatttata

SEQ ID NO: 1529 - DNA, 229 bp, Homo sapiens
acccatggagcaggagtaatcatgatcacattgtgtgtgatcatgaaatcttgctagggtttcaaaaaataattatacgaaatttttgatctgtggtctgaataatgaatatgattggtagtactgagcatagccaaggatgttgactccagggggatggtattaattaaaatatctttcagataattcagaaaatataagcaaaatgttttgttatattcatggcatg

SEQ ID NO: 1530 - DNA, 406 bp, Homo sapiens
ttgtttggagtattgagactgggtagactctgaaaaggtgattatgattataccaatctttgagtgtttatgactttgattagtaaagcttgaaccatgtaacatccggagggctggaggttggggttggcctcatctactctcatgaatcaagaggcatgatgtgtgtaattggtatatgcagagaatgcctttcacagaaactgtggaaatataatactgacgaattgatgtgggcactgggtccctgacgaaagagcactttctggctatgatagacaggatggctttggaggtcacccagaaaagactgaaatccccaaggatcaatgctacagggaagaaattgagagcctatgcttgttgattgatttaataagttatatatcaatctgacttcagtctt

SEQ ID NO: 1531 - DNA, 763 bp, Homo sapiens
tctgggatatggtgggaaaaaatagctcccagtaaactcctaacaggcataagtttagggtagagagagagtatttatttatgaagttgtggatgatattctttgggttccttcgagaacacgtgggaccattgcttttttagaatgggaaagtgatggtcagtaccataaaatgtaggtttttacaaataagagggacatttgagttacatatagtttggtatagttcagtaatttccagtactattggaatatcttatttgtcctttattaatacaaggggctgtggagtggactggacttaagaaggattaaccttaaaaagtctgatttttggactggtgcattaaaaactgtaataacatccagggacatgttggaagtagacaccattatttctcaaatatactgattacataatctgcaatttaaaagaagatggccataattatctaatggatttttgggaggctatgtcagagatgtctggccttgtaaatgatcccacacagaagatgatcaaatgcacttctctctgaactgctctattttcaaatttattaaggaaactaagggagcttaattagcatagtggtaggccagaagacataaaataataaaatgttgagattacagaatagtgggctgtaataaaagtatgcttaaagtgtaacatagaggaataaatggaaataggcaagttcacagaagaagacatttgaatttggctttgaaagatgatttgaagttgactagatataga

SEQ ID NO: 1532 - DNA, 54 bp, Homo sapiens
cacatcaataatcccatgtttggaacaatgtgtaatcttttatatcttgcttat

SEQ ID NO: 1533 - DNA, 329 bp, Homo sapiens
gaaagactgatgaattgtgtattcataaatcagataagacactgtatatttctatttacctaatttttattatatgtactttaacatagttttatactttagatggttggatgtgttatagcaaaggactcaaattgtcttagtagatggtggctaaatattcatcaaatagcaatactttctgttggggtttgctcttgagtttatttcaaattatatgaaaggagagagaatgaatgtgaaaaaggaaattagtagtctactgtattttaatatagcatggtttttatttgaatatgccaagaagatacagagtaattgacagtctg

SEQ ID NO: 1534 - DNA, 870 bp, Homo sapiens
gacaatctgattttttaagagaatgaatgaaagcgttcaaataggctgccctttgtcagaatttatgtaagcattcagattcttaaggttgtgttattatacaactagggaaaaattttcaatgtcaaaatgtgatttaaaatataaatatgcacttaaaaattttggaataattgacatattatatgggaaagccaaactatgacagtattgtgaccttcttagctctatttctgtaatatttccactctcggatcaatcaagttcttcaactgaatgtttagttcaaacttagattctggagacagtcctgtttctgatcggagaaagttaagaaacctgaggaagatagcttgggaggacctatattaagtgtctttggacaggtatagtctgatctagtgttcttgatttgtgaattggaatcctgataccaaactctaacttgtgtctcagtttcagtgacgtgttttaatttttgtcctatgtcttaaccctgctttgataattcatctagtattcctgctacttgagattataactcatactttatgtctatctagaactgaagtcctcaaaatctggggccatgctatctgttactacgactctctgacaatccaactacctttgtccttgaatcagcggcctccaggtgtcaccctactctgtacactgtctactgggagattcacatctattctatactagtagctggatcttattgctggtctcttttgacttgttctgtccatttgcagactgttctctgatttcaaaccctaacagaccacaatctcctatatttatgctaaaataatggttttcaattttccccaaaatctgtggaaatggttcaagtagtctatg

SEQ ID NO: 1535 - DNA, 33 bp, Homo sapiens
gagcccaccccaaagtgtcaaccctatggcaat

SEQ ID NO: 1536 - DNA, 115 bp, Homo sapiens
tgagccactgagccaattaaagacatccaaattgtggacatttagttaaatttacaaaagttattatagcctaaaccaggcattggcaaactatggcttgtgggccaaatctggc

SEQ ID NO: 1537 - DNA, 690 bp, Homo sapiens
tttggccttttgcagaaagagttgtggacaccttgcttaaatcaatgttaattatattgtcttctgtttgaggttgaaagcatcataatggatacattgaaaacttttaataaatattaactattattgttctagtaaaaaacacacgtgcaatggagtaactttctttttcccagttctagataaatcttctgccatctcctcttatttgaagagtatcctgagatggtgagaaaaatagttcataataaacaaaaaattctgttcccactttgcagacattcatatgtgggaattgagacttttatttataccataaaaccgaaccgaaaaaaattagaaagaaattgtatgtaaagcttatctagggctgcacctgtcatatgtacttctgatttcaaaatgaatgttcactaaaatactttcactttcgccattcattataaaagtggttataatgcataacattataatgagtattttataaggaaatactacatacattaacttgtatttacactttaaaatagtcatctattttacattataggacaccaagcaatattgtacttgaaaaaaattgaaacaaattccattcctcaaaacacagttgaaaaccaaggatgtagaaatattttagctgcctgtttaactttgaaatctttaactttgaaatgaggccctcttata

SEQ ID NO: 1538 - DNA, 181 bp, Homo sapiens
taaggccctctttcttaagatctttgtttagtgctggagtgttttttttttttttttgtatcttaaacctattgaaatgcttcacaatttacttaagaaaaaggcacctatcattctggttatctactcttaaaataccaaaaggtatttgtaatagaggagtggtaagtagtcaagttat

SEQ ID NO: 1539 - DNA, 241 bp, Homo sapiens
gtttcttagtaaacacttattatctaatttcataatggatttgacactacacttatgatttatagcacatgtagaggttttgatgattttaactgcagattgaaaaaagtggagtcaaataggttttttttgtatttgtttttaaagcctaaactattgagtctataacaggaaaagaacattataaaatgaatacgtgattgatcaaaaatagcacatgtcagtaccccaggtataatag

SEQ ID NO: 1540 - DNA, 196 bp, Homo sapiens
gtccctggttatcatcctcatcctcctactgctatggacaaggagacctagttcacatgtccattcctcaaaaccagttggtaggcctgccccaaccaaatttcaaagacttagaacagagtaagggccggccttgcaaaaggagaagttagcttctggcacaacaagaaattagaatgctgtgaagatactcata

SEQ ID NO: 1541 - DNA, 969 bp, Homo sapiens
cccagctggtaggtacccttattacatctttccttgctttcagtagcatggaaataagatttcgtgaggaagccgagtgtaaaataggagctgctctgaaattcctaccacaggatcactttccttttgatctcatacatttatacatggaaatcatgaaaatccgtataatatttcctgtaggtctaggctacgttaatgcagcaagcaaatataacctggggataaggtggataattcagctcttgtagtccgttaggaacagtcaaataactctatttatcttcctggtagaagatgtctaaacctaactgtcatcagggataaaaatgcccgaaggtgctcaatacctgttacctcccacagaatattcgccaccccgggcataaaagtcaagaggactgtgggactatcagtcaatgtgttgattagtaatctgctactctcctgttttgtcctgttaatgtgaggacaaaagctgtggtagtattgatacaacctgaggaacgcacagcaatttcaatgtgtcgttcgtcggaatgaagccatagctatgtagccttacaagtgctaaaagcaattagttgtaactgatcttgactatcaaagaaatgcatgggaggctggttgtgtggtgtggtatccttttaattcctgattgatttttgctgtaggttattttttgtaatttttctaataacaaacactgggtgacaatagcttttcttcaagcatgtattgtgatctttcgtttcttggtcctgacataatccattagtggctacatcacaagcctggatagaaacacagagcaggtcaagtcccattacaataaaaacttttgtttaacaaaatggttcccaagtccttctgtggcagaattaattcaggcagcatgaaataaagtattttggtatcataaacggtttggattttctctttgaattgctcttaagtaattatgaaatc

SEQ ID NO: 1542 - DNA, 120 bp, Homo sapiens
gaaagttgtagaggcctgctaggaaagggtaacaatctgccggagacaatagattcctaaacccacaatcaaggctcagtgtcttatatgctagtgtagggccgtgcggggtgttgtgga

SEQ ID NO: 1543 - DNA, 284 bp, Homo sapiens
tggctgtggaaacataagagaaaaatctggatttacatacatgcttcttcaaaggtaaaatgtgtgttcagaagctgggtagtcttgtggaaagtgtgtttctgtggtttagatttaaaatctcagttaaaatcccagcttctttgctttctaccagtgaaaccaactggttacaaatttctcatttgtaacaagacgatagtgaaccatgtcttataaggtttggttttggtccaattttgccaaataatggtaaaaaatgttgggtaaaatacaggattctc

SEQ ID NO: 1544 - DNA, 915 bp, Homo sapiens
tattccataaaaaatcatcaagtaatacatttaatttgcttctcttttacattctcttttgacatcacttccttcctataattcctgaacaaggaaaatgttttgtgaactaatggtaatgatttacactggaaatgaagattattcacctttttataaatgcaggaaatcagtctcatttatatgatacattttattatgggcaagaagcccaggtgtcagatagtgtttgctttgtcccatgacataaccgaaagtgtatgttgatggtctttattactctgcagtaattatttggtaaaatgagccaattctaagtgagcctctggtcttggcctcatcccttttgcttcttccccgcttagacagtcattttcctgtccttcttgcccaactttctccccaaaaagcagctgtatttgtgtgtctcatcctgagagggcaggcaactggctgctatcaaagtcactctgtggcctggccagtggggagccatgaagaaccatctgctgcagaaattgagtgtcacctctgcagtagtcttgtttacagaaagatcatggagttattcttaaacgaatatatggtttgccaaagaaaaggacatagttttaagcagtaaataaggagaaagctgtaacccatcttggtaagcctgcatacttagctgcatggaaatagtttttctgtaatcatgagcaatgacagcgggaaggcacactggaaacacacctcctattgaatgcagtctcaaatatgaaaacataaatgacaagaacacctaacttgtggatgaaaatcaacaaaagtatttgtaaagtttgtattaatcattttaactctcagagcctccctttgtagtatcatcccagtcatatctattgcctctaaggctccaattgcagggcgcgttaa

SEQ ID NO: 1545 - DNA, 1818 bp, Homo sapiens
taatacctactttaaagggttgttggaaaatttggagacaatctaatgattatcacaggaagaacttgaatgtagtagatgatcaataatcattaggtattataattagccaatattaagatgattgcttttcgttattcttacccatacatgagtacaataaacttactacaagaaatataggcatctgactaaacatacagttttaatggtggttgacaacacggcttaagttaactcttacttgaatacaatacaatgcacgtttttaaagtgccaattatgggaaaatcattgtccttgcattgggaggtacataaacaaaccctgaattcaaaagttggtggaatgatcaagacatgaagctactgaactgttaactattttgcaaaaggacaacagttcatttctctataaaatactctttgaattctttctgtaggacatgttgatattttagttagtcatatttcttgatcatagctccactgaaaaacatttcataacttggttaggattcaaaatttttatattattttctttttggaagctgtctctctggttgagaactcattaaaaaaatgtatcacatattcttacctaaaactgagatgtatctttcttgatactatttctaaatgaaagcatgaagatattgaacctagcctggtgctataggaagagaagaaccacaggaggtatgaacaaaaataagaaaaagacaaagagataagactttaaaatgtcaagaaatgaggagggaataaaaggagcagctttagaaagaaaatgatgcaaaaactggaaaaatatataagggaaaatgaaaggcaaaagaaaagttaagtaaagagaaaagcaggtgaaaagggaatttatgtcagaatatgtggccaagtcataagatctttgtcttacttttggtctgaaagaggattttcttgcttgaaaaaatatttttaatccatgacatttgttttttacttacatctcttagaacatttgagaatcctggccactgatatataaatctatagaatcaaacaaattttatgtaattcttgctatttttagagatctgctgtttgatctcctttgaatataatattagcagtagatttcattaatgaacactgccattcacaaaacagtcccctcttccagtggggcaaaattaaaattgtattcagctaaatgagaacaccaggaatcactgctgctactttgataaattgtgagactgttctaatgataaaatactttctagttctctttataaacagtgggctctcatcctggaaattccaagccctcactgatgtccaaaataataagcacaattggaggattggagaccatttttctcagcatggagatgtactcttatttctcatctcatgttttaaagtgattttcggaggttttcattttgaggcatagattccgcaataaagtgtagcacatcgttgttttgaccacagtagagttgtgtttttttaaatgcagtttgttccatctttaattttctaaacaagattctgaaaaaatttctgggaagttttcaagggaatgatcttacatcttagcattgtgtggcatttacatttgtataagcctactatggctctgaacagaaatctcagtgagtcaaagaatagggtttcttttaaaatgtgtttatcaataaaataactggaaaataagtttcctttcaaagttttgaaatgacaacaacatcctatttgtcatgaacatgtctggctggttaaaaacaaatagaaaattatttttatgtgtcttcaagatacttttgtaaag

SEQ ID NO: 1546 - DNA, 3334 bp, Homo sapiens
cccaaagttagaataccagtaatgcttttttctaccaccgttattttcttctagaaaatgcatatgattaaaagcaaatttccctttcttctccttagaatactgctttccttgatattaatctgaccataaacaaagctatgagacactaaatctgtttcttagcaccaaagatacaacacagaaaatcatcaagagatcctcaaatcaaattttgctttggctatcaagattggaaaagaaatgataggaaaaaaagttcaaagccaacaggaagctcttagaagtcaagtgttattattgtagcgttatcatcagtctgattcattgcagtagtaatagttgaaattgtttataatcaaagagaagaatggaaggaccacgtcatcgaatattttgttggggctctttagggcttttcacatggaagatatgtattatataaaatatactagtaaaaattgatttctcacccttggcactatgtttttttaagacctgttagcatatgtattattttaaaaagtaattggctcctaagaaagtaacagatttcgttcaatagtcttcttttgagtattaatatcctgattaaacaaaaaatcttcatagttcagtcccatgaacaaagacttccctttaaaatgaacattctgtatcaactctaaattaagaacttctccagattcaaactctgaatggattgtgtgacagagaatagaacatggactccttaatctctattcttttccttgtctattctaatttacttggttgtatcacattcctaatttccctcaaatcttagggaagacaggaaaaatggtcaagttagggaagaaacgtgcagacatcttatatggagcccatagaatggatgaaaaaattagagaacaattttaatttaaaatcagttcagctccaaaaaggaaagggttaagccgagaagggataggtcttggcatgtgagacacgtttgtttggatttgccggtcatgaagtatttcccttagttggtccacatcagttatttatttctcataggttattctgctatggacatggtcagtgctcttgtagaaatgctaagatttttgggtgaggcaaatgatatcctctctacaaggtctctattggtagcagtctgtggctactacaatgctttcttttctaacctgctttccttatctttgaattttggaatgctgctctgtatacttggttaccaagctgatgtgtgtctctggcctggatgcttgcttctccattaatactgcttacctgttttattccacaaccttaccttaaactctgatacagttgtgtcctgattcctgatgtggtttttcaatactttatttttctctccacatataacatacctagctgttgagtgcctgggttctacctcaactaataacttccaggtattattctgctctgatattctgtctcaagctctagctcttaccatatgttacttggtctctgttcgttaccttctctctgagttctatttgcctcctagagtttcagaacaaacatttatgaatacgtatggaaaggacttctgggttccataagaacactgctttcctccttatcaagaagccttgaacaaatttttctttgtcttatagctggtcgaagtctgactgtcaatacaatcatatttattataaaagataagtcccaaagggtaaatgtttgggtttgatgctacagtcttctattttgtttcttctaattaataaaactttgcttcagacatggtgtgtgggaactgtgctgagtctgaggaaaagctgataaatctctgaaaaaaattgtgttataattttgtatagtagtgatattgctgcagaaaaacaggtgccaaccaaaaagcctagctttgaaagaaagcttcatggttgagttatgagacagctggggagcagcaaaatagatatggatccataagccctgcaggaaaaacaactttaatcagggcctgacacatttggtgattgtaacgaagtctcttggtatgtgtaagccctggatcaaatggcaccaattggctattgacaagcgttccattagtgcaaaactggatgaaaaactggccgttgccctgcacagactccaataataagaaatgaggttcttgtacggaaagggacttagtttgttttctaaaaacatatgtgcactggcccaggtgatacctctggtggactgaaattcctctaagctcagccttcagatactacagtggcatttagtgaaatctttccaagtctctccaagtgacaggcctctttgactccttaaattgattccatggttctgaataccagtagctaatgctgacagtttgacccaggagcagggagcgtcgtcctgccctgagagcccctcaaatggattttacaagggagtggtggatattacgcttctaggtgcggtgaagcgtgtttctagcactttccacagatcataaattaatttgaaatgaacttctcccctcccagaaaacacaatatcagagaaggactgtcatcatggtttttctgtagcatagtacctgaggggggaaaaatcattttctcctgcatttgttgactggacatgtgattggtgccaaatgctaggctgccacaaatgtgtgccatgtgtgtccaattcaaaataatttgcagttcggtgtagattctccacaccgtcagctctgaaactgaaagactggaaagagctatgcatatttttttctaaagataggtgttatgtaaagccccaaactgatgtttcagggaccccaaatgtcctgtcctcactgtttctgtaagtgagtttaaatataagtgactattcttgatagttacctgggaaagataagaagtagtttgtaggacatgcagtcttattttataattatgtgtgggcatttggcaaacaattataaaataatatagtatcctctctagtagtaatgctgcgaggtagaaggcataaaaccaattttgttcttcagaacttaaaattcagtgtttctttcacttgtgtgtagcacctgctgttttatatatgataaaattttacagaattgattatattaaacttggttgatgtcattagtttactttcatattctcttttccttagtatatagtaggacccatagaaaacatatatgattaattgtactatgattgaaagtgactgtgagttaaagagaataggaaatattgaggtggaagagaaaggagaaaggaaaacaaaagggagatgtgtgttagtaggcaagtatccaggtaattcaatatcaactacctttttagtggccttcttt

SEQ ID NO: 1547 - DNA, 115 bp, Homo sapiens
caggagtcatctcagatgactttgcccaccttctttgtcacttaatagttataagcagttgtagagttcatctccaaaattccctgcacttttatagccaagtttcctgccttag

SEQ ID NO: 1548 - DNA, 42 bp, Homo sapiens
acaatctggggtctatttattatatgaaaagcagttttcaat

SEQ ID NO: 1549 - DNA, 299 bp, Homo sapiens
atacaaatgcaatgataaaagcacaggttcattgcgatgatggatgaataactcccagtttggagaaaacatctctattgtttgggggcatttggcaatgcatagacttaagagctgaaagaagatttgatcttaattcacatttgatttgcacttctggggcatattgatcttgaagaagcccatagcaattggtgactactgtaagggaatatagaaaaaaatgacactcacgtgaaaaactgaagagagattttattttgtcctttcagtctttgatgtattgatacacttaaatt

SEQ ID NO: 1550 - DNA, 48 bp, Homo sapiens
tatagcttcttccaaaagaagtataaaatagttgtattagaacatata

SEQ ID NO: 1551 - DNA, 421 bp, Homo sapiens
gtcttaagttgactctgttaatatgtatgtatatgtataaaattttaaagaattagaatgtattgtaattctatgtaattacatataattctatgctgatgttggtaaggatcagaaaaggagtctggaactggagagggagaaaggaagtcacgtaatggcaaagccagaatatgtattttgagagccagtcttaggggaagtggatgaagcagaggtaaagtgcatgggggaggcagaatgcacagggccatagaacttcattcctctgcctgtcaagggggatttggctagtgcaagggcagaaagagccagggctgagtggtacacagggttcctatgtgttcagcctggagataccatggacagaggtaaggccggcttcctttgtggattaggaaacaagggacgtgaaggacct

SEQ ID NO: 1552 - DNA, 570 bp, Homo sapiens
taaaaaataggaaacaccgtgaaaaaaactaccattgggtacacatggggaatgtctttttagccataccgaactaattattaacataagaattcccaaaagctttttctatctcacctatgctctgctgatactctagagctctggtagtactgagaatgagcggtcaacatgctagatatcccttctcttgtaaactcagcttcttgggtgctctcttaaattggagagcatacatctagggaagaaaatgtatccaatgccttctgtgatgccgggttcatgaaaacccaactgacactgctagggatttgaaggcatgtaaagggctgggtaaagggctgagtaggatatcatttgtagggtgcttcttactttgttgtgtaaaaggaagttgttatattaagattgctttcaagatgtggctaaaaagtaatgtatgtgcttcaggcaggaaaaacaaccaattcctatttctaaccactagcccaggcactttaatttactcctcctaactgcactctggtattagtttatcatcctgattttacaataggagaagctggactt

SEQ ID NO: 1553 - DNA, 372 bp, Homo sapiens
ctgtcacatcttggctggcagcaggagagtcaaacctgacagggaccgtgaaaagcctggagttttcagcctgctaggcaagcggcggtgccatagaggtaagtccctgtgagctctgtcatttatttctgtctactttaaatctcttatctgtaaggcgaaaagcatttacgaagctttcaggaaagtgctttgtgattaccagcactagccgagcaatggcttgcctgtttttcacagatagctgcaaaatatgtcttttagggagaattatctgctttcttccacttagattcatatacaaacacaccgatgaagaaatatgttttggattcccatagtgctaggtatgagcagatagttgctttcttt

SEQ ID NO: 1554 - DNA, 244 bp, Homo sapiens
gagcagatagtttctattccaggttgcactgaatcaggtgaaaaaagcaagtaaacactgaaaaacaaaaaagtaaatattcagttgtaaataaacaaaatccccaaacctaccccggtgacaaatttctgccttatggtaattgttgttaagagtaggaaacccaagatgtaattccattggtatgaaatatcaggtggtccctaccagtgagacaaatattttttaagaccttgagaaaata

SEQ ID NO: 1555 - DNA, 36 bp, Homo sapiens
aggctaatagctctttctaacttaaaaaaaaagtgg

SEQ ID NO: 1556 - DNA, 927 bp, Homo sapiens
taaacaaaaacaaaaatgactaaaagcatacctagcccctctttgtagggtctacttggatgatatttttatctttgaagagagaaagaagatgttcgaattggcacctcccttggcctgatgagagcttaatctttagtgtcctttgcgctttgtccatgcatacttcagctatgggagtaattcttaacaaattgtacagttgaccttctataagccagctcctcctgtatgattaaaagattgagtgttgcatgagaatgtgatgattcacgaagccctagacaccttagactccttgctctaatataagttgttgaaacacagacctgagatccttgctgcattctccgggtggaccatgggagccttcagacctggagcccaggccttgctgcagctgctgtgcttatactcctcccgcctaggcttctggaatcagggaattcctgagggaggaaattctgagtcttcaacaaagagccagtttttgtatattcccactgaaaaactgaacataacctttaaagggtaaagaatctcttattctatgattaaaaaagtatattcaaagccaactgattctatttgaaatagctcttccttgcgaggtgcatagttctggctggaaaaaggctttaataagccaggcatggtagggtgactgcttggctctactttgctttgctgttgaaacattaagcgtaatctgatgtgtcaatagagtcacctcagatactcagaatcattttaattcctcttaccgtcaaaacatagtgtcaatactgacacaaattggcattaaaaatatatgcgaaatcacctggagaacaacactttttactgataggagctctctttaaaagcagtttctgtcaaagattcaatttgaactcttttttggctttgaattttacagagcagcct

SEQ ID NO: 1557 - DNA, 626 bp, Homo sapiens
gccctgacctgctttgcatcattcaaacctatctgtggaggaaagaagcttttcctttgtatctgaccccatgggagatgctgtccattcccaacgttgccctgagacggatgtgcaagatgacacataagtggatgacatcactcatggctcatgattaaatacttccctgggactcacaagatgtgttcagaagaaaatgggaagaaggagtgggtgacactgacaacattcttatacattccacctgggtgcatatttttactactctagatagatttcaggagagaatatgagtgtacaaaatgaaagaatattgatataaaagccttaaattttagttttgagggaatacaaacaaaaatatgcatatatttgccatattatatttcgtatgctttctaatatatagcacaaaatatgtaaatgtatgtgatgtgtaatttgtaaaatatatgcaatttgcaatatatatgttcactgtatatcacatatatgtagtgttctagatccccatgaaaatcaaaaaactaggacaaaattttatttttgataagtgacatattttttgctaagtggcatattcagattacctaagtagtataactacacattcattatttgac

SEQ ID NO: 1558 - DNA, 312 bp, Homo sapiens
gtaatgttacatttgaagaggtgaagtgttctttccgcgttatttaggaaattatttatttattaaggtgggaaacccatcaaatgtatgcttattgacattttggcacacacagttgtttgttttattttcttgctttgcaaaaatctttagggaataaatgacctgttgaactgaaaagtgaacatcattgcgtttcaatctttgaaagcaatagattctatcgataggaatgaccagattttctttgttgtttgaaattgttgatctggtcattctttttctagtttgctcatgttagcaggtgtttca

SEQ ID NO: 1559 - DNA, 982 bp, Homo sapiens
ctggcagcaaatcactcagctgacctttttcataatcaactacaataaacggagtgtgtgtgtatgtgtgcgtgcctgcacttttggtgtgatggacagtttgcttaaatatatgggaaaagttaatccctctgcccctgacctttggcacaggaaccttgtgcttccagtagaaagtgtggtaaatgccaagtcctttgggcagagaatgtctgcattaatgttttctatgctggagcctgagccatagattttctgtcagccattctttgcactgcggatatggaataggttgagctgtatacagaatatagtgcctgctgccatctgttttgacaccctgaatattttaaccctaggcagtgtattaaaggagaaagtctcccagtccctatcatgcatgtgattgccgtggagtaccgaaggtgaaaggagctgtgcggtttaatgtgattgtcaaagggtcagttgtcatgttaattatcaagagctgagtgattatgacacaaagagggaggaggatggacatggtacataccaaccttgtaaataaagttaactcttgatgttcttggaagcccaaggctgcaactcttcagcatcacacaggcctggatgcagctctgcatatgctgatctctgtctggaatgcctcatcaccatgaaggttttggattacagggaatacgtgtttcaaacagggtaaggcagctttggcagaaagaccttgcagtaggagatgaaatgttgccagtctggcatctgaatttagcagttgagaagccattcttgactcccctacctccacatagcctctattgattcaaaatgtaaacatcccccagatcaattgtttccgctccatctgctttttcatggccttaggtgctctcacatcttgcctagattaattgccagattattggaagctgcctgtccgatccttctgtgtaattttgaaaataatgcaaatctgccatgc

SEQ ID NO: 1560 - DNA, 419 bp, Homo sapiens
ctaacaaaataacatgaattttagagtagaatagtacatgacagacagtagtcctggtagttggtcagtaaaagagagcattcatttaggagatggttggtgacatacattcattctcataactctcctccctggacctctctcatccctcacctacaccaatcctgacatgatcacttgaaattgacctgggttaaatcatataaatctttgtattccaccttcttgaatcaattataatctttagtgttggttgggagaggaaggcccttcttccttctttctctgatttccaagagggaaatgtcttctaattattcctgggctttttttcttttcttttcttttcttttttttttttgcctcatcccttacaattccccttggagtgagaaagacgactggttagtttgggaatt

SEQ ID NO: 1561 - DNA, 753 bp, Homo sapiens
tgaacttagctcaatgcatagaatttgagagtgaggagaaatcttagctctactccaaatatattaatctttgaaaatttcacttctgcttactaaagaacagtagatcactttatgttacttagagtcagtcatcattggaaacattaattaggcttatgtttgaacaatgaccatggtgggatgagggcagtgacaggaggttaagtgtaagatggaagccagaaggccacagcctctttacatccaggtaagcagcaagattagtactagcagtgagggtttgaaagcagaagcaaggaatgaagatgtctgtgtgtgtgggaaggatacaatgaggataagtatggaaataaagtaggttgtagataccagtaatccaagcaagaaaatataggtcagaaatccagggaagaaacttggataaaaggcatacagaggcatagaacattaagatggtaagatatcctgtatgtcatcaagtctaaacatacattcattatttgtatcatgtcttaaatattgtcactgtactatatcagctctgtgtagtatctacctttttctcagaggcccagccctcactatgtattatcttactttgttcattctgtctttggacctctctaactattctgctttattttgagtcaaatcaatttcttttgattaatctctatgatatttatcactaactgtgatatagctgagccatggaatctcatggctgagagggacataacatgatacttt

SEQ ID NO: 1562 - DNA, 423 bp, Homo sapiens
atcatatccaatatctttaaatgcatttgccttgtctactcaaacaaatgtcagtggcatgcaaaattccagcaatttgtagcctccactctctgatgttcatttctattttctcgtgtaagttttgacaaacttcttctgcttactctcctcctttctatattctgatctttcagaatacagaattcttatctttcttgcctcaggtctcatttttctcgtatccccttttgaacaagtttctgctttagctctttgtctctgagatcattctgctgtttgacttttggttctctgtattggaatcacttataagggacatgcctacttactgtccttgccagagaaaggaatttgacagatagaacctcaatctgttgcagaatctgtttcagaatgccatcactactggcttgagaatac

SEQ ID NO: 1563 - DNA, 91 bp, Homo sapiens
tttgatattctagttagtacaaatgcattttccctttatctgggttttatatttatatcttattaggttttttttttgtctgtgtgctcat

SEQ ID NO: 1564 - DNA, 502 bp, Homo sapiens
ccaataatctcaaatttactttttagagtcaggatactatattgacttataatactttccctgaacaatcctcttttttgcttgggaaagatgtgataaagtccttagagacctactcttagagtctcagagcatccttgaaatatttcataatataagtctcattctaactctttgagtacttacaatgtacgtggcatgccactagatgctataagtcatgcacaaaccaaaacaaacaaaacatagcccctttcctcagttctgctgctttattgctggggcacaatcttctacaaagtagtaggtttttaaggacaattgagaagttgaaacaaactataggaggctaggaaacgtacaaattgagtaatgagggaaggctttgtggagaagatttcgcttgatctgggattcaaactgtgtatagatttgagtacatgaagcacacaaatgagtgtaatggcgtactggtaaactggtttccccttccacttcagca

SEQ ID NO: 1565 - DNA, 272 bp, Homo sapiens
gaaggcttttacacaggaagtgagaccgtattgtgactttaatgatagatgtcatattcatagtcagagtgggagaggagatccaagcatcctgagcaaagagaaaaagataggaatgggcgtgtttgagagaccaagaagatactgacccgacaagaatgaggggttcacttaaaggagatacaggaaataaagttgcaaaggtagaatcagattaaggagagctctaagtcttaaggcactaggacttgaatttggggtccttgactttt

SEQ ID NO: 1566 - DNA, 177 bp, Homo sapiens
gagataattatacagtagtgacagaattcaggattagaagagggggagacctggggcagtgagaccaactgtaacagattagaagggggtgaggtgatatagcttgaactagtgtgatgatagcaggaatggaaagaaacgcatttcagatttcagaaaatttgtggggaatgttgg

SEQ ID NO: 1567 - DNA, 97 bp, Homo sapiens
cctcatcccaaatatctgcctctcaaaatcatacccatgaatcttcccgattcccccgccacttttttactaaccgtgcatataagtgtttcccgtg

SEQ ID NO: 1568 - DNA, 177 bp, Homo sapiens
gaagtagctgtgtataagggctggacctgggtggccattcttctccaataaggttttatgtggctgtgattatatatttggttgcgactgacgagtgtgtgtctgactgagaatgacatagctgtttgcatgcctgagaatgagtctgtgactgtcacacttgaatatgggcagtgg

SEQ ID NO: 1569 - DNA, 69 bp, Homo sapiens
tttgcttaactccatctaccatagaactaaccatattattcagtctgtgtttgatttatttgaaggctg

SEQ ID NO: 1570 - DNA, 154 bp, Homo sapiens
aaaacataaagaggaaaggaatagagtgttatgaaaagagaagaacaaggggattgtacttcagctggtgtggactgcagaagatctgtgaccctctcagatgggagcactccataaccttcctggttatatcctttttctttttgagacagct

SEQ ID NO: 1571 - DNA, 567 bp, Homo sapiens
ttgctggctgtattctatttgtggaagaaaagcctcactttcttctgtgagcattattgcccagccaagagtccccagcattaagggtagctagaggagggatctagtcatccaataatcagttatatcaattaactctcagttctccccctcactgtgggcattattcagacagagaaataaagagggaatctttgctgcaacacaagagaagggaactaggcaccaggaatatgctgatgggaaggtcaaggctttgggtaggtggggctgaggggtgataaggtgccccgccccccaccttccaatggggaagcaggggagagtctgagggaagttgggcagttagctacagccaagcaaggatgaaagagcacagagcctttctcccagagacactggccctctgaggtcccagaccaggccagcctggaaaaggtggcaatagaggaaaggaggccttgacacagatgcccacagcttttccaggagggtatcatgctcaaggaaaggccttagctcatgccgtatcgatactggctactagggagagagctctgaaatcaa

SEQ ID NO: 1572 - DNA, 556 bp, Homo sapiens
taggggtgtgttggggagagggggataggatgaggaattcacctagacaggagtagagctggcaagtaatgtaaactaggtgatcaaccaggatagggaagaaaagattgagtggaactaaataagcaatgaccaggctctgaggatccagaagcccaggctggtcaatggaggactacagggttagaaacccaggcagaggtcacaacctacatgaccagcatgagattgggttacacacagggagcaccagcggcaagaatggaagaaagcactaaaccaagggcttggagatcacttgtctcattaggccactgttgaccactctccagttggccagggcaagtctcagtgggcgggtccacagatagaggcaggtgcctcctgagggtgcacatttcctaggtgtgctcctggcacccacccaccactgcacccatttgtggcggactttgcttgttttttccacctggggtccactgtgaaatgggacacaattatcctccttcactttctctcaaacccctgagcaagcacagaaactgtttgaggttgg

SEQ ID NO: 1573 - DNA, 53 bp, Homo sapiens
tggtactacaactacaactagtaaccacagcaaaaacagttctagcatagcag

SEQ ID NO: 1574 - DNA, 1309 bp, Homo sapiens
agcctaacaaactagccaaacttagtgttgagaattagtgtttaaaatgtgttaaaaacctatcatcagcctttattgaaatataaattgtgttgaacctgatcttttctcgcccttttcctgactttttacattgcttgtcaacaatattctacctctttattttattcttggaacaggtgctactgaatgaactatttcaaccctttcctcaattcccttctctttttaaaaaaattttacctgagactgggagaatgttagaagtgtgtaatcaggcagctaaatgctctagtaagaataatgatatcttgaggcaagctgcagtctaatataatataatgaatgcatattagaaatcgactttattatttcctatctctaatgaattgatacataataggccatatgtgatgtgtctagtgcagcgtatctctatggtccacatgtactttctatgacaagaataaacaaaactgggagaaatgaccggattttaaattatcatttcacaaagtcatgtttcataaaatatattgaactgaagtctttccttgaagttgtgatgccagtttcctgttggagcagaagttggtctcagtgactatgtggcctgaggcagggcctgagactgggaggtccagcagctcaggaaggggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacacagcttttcacaggtggaatcactgtctcaaagtatttccctcagttgtcatagggcctgaaatctctctaattcactgggcggagacactgtgttcaagtggccgaaatgacaatgttagtattttactgatgacattaacagtgattaacatctcagagaggagctgttagtgggtgttgtccttgatcataagcagatacccagaaagcatgggacagaggagccgtgtgagctgtggtggcctggcaggaacctggatgctggaagggagctctggaagatgttgggctgggctttggggatggggttgactattatttgccagtttccaccttcccagaaccagtcctatctacctttcaggaggagtgccactccctcttcccagatgtatgcaacacaacacacacacacaca

SEQ ID NO: 1575 - DNA, 3668 bp, Homo sapiens
gagagagagaggttagtagccctttcaaagccttcagactcacctgtgtatattttatatcatgtatattttaccaagtttccctgtcctgcatcttctcttcccataatgcctatcttgaatcctgttcactcttccccatatgctgctggtacagactgtattggtgatcacgtaccgagaacccccaaatcctgagtatcaggaattccagaatcgtctgctgataagagcccgggaagactttggtgtggagctgggcccttccctggtaagtagatctctcccttcctgagagtcaggtcaagctttggggaagggcttctctcccaaactcagcatcaagtcttggctgtggagcaagcccaactttggggggtctccgcttctgtccaggatttttccttctgccctatggagtagttaggaagggatggcactttaggaataagagggaagaaagcaaaccagaagagagaataggtagaagggagaccccagagagaggggaaggggccttgcaggacatttggagagtactgctgaagttgccacccccagatgaacctcatcgctggctgcttctatgatgggatcctgctatatgctgaagtcctgaatgagacaatacaggaaggaggcacccgggaggatggacttcgaattgtggaaaagatgcagggacgaagatatcacggtaatgaagaggggtcaatgggggtctgagggctgatgtcaggaatagagtgggctgaagaagaaacagatgtcaggatcaccacagctttagtgggggttagtgaatatggcagagttgcccacacctcaagatcggggaagggtagactctgagggagccgtaggcatgagtgagtgggagaggagcccagggtagacctcaaagaaaggacactcttttctgtcttaggtgtaactgggctggttgtcatggacaagaacaatgaccgagagactgactttgtcctctgggccatgggagacctggattctggggactttcaggtgatggaggaggaggcagggaagagagtgtggccctgcaaaatccagctttcaagggttcagtcggggcagaaccaaaactactagatgagggatttgttttctctgctggcactgcatcctggctgggtggtaggctggggagaaaagcagcgaaacagctggggtctggggaggaggctggtgggagcaggcctgtgggcccagctttttgcttccttacagcctgcagcccactactcgggagctgagaagcagatttggtggacgggacggcctattccctgggtgaagggggctcctccctcggacaatcccccctgtgcctttgacttggacgacccatcctgtgataaaagtgggtgtgtgcagggactgggagcagctttcctccctttgctttccattcatggcctccaccctcactgaccctccactcttaactgtgcttctgcctttacgtctgcatccctccctcctcatttcttcctactcccaaggagtctgtctatgcacctatgcaccccgttctccattctgccaagtccgcacacagtcttcctcagggtctctatttccccttcagctccactttcaaccctggcaattgtggctctgggcacaggaatcaccttcatcatgtttggtgtttccagcttcctaattttccggtgagttctgggtttcttgctgacctactccctgcccccattgccacacaacctctggctgaagccaggtggtccctataatgtgggatagggtagtaggtttcttaatttgctggttgtctcttagatccaacagcgtcttcctctctagcctttctctttagttgtcgcttagcctaggtgtttgttccacttttggtcctagactggatatactaactagtgtttttcagtggggttaagatcaaaggtgaattttccattggtcttcttttaggaaagaactttcacccccagtctctgtgtttgttagtgagcatagggcatgtgccagatatgccgagaatgcagccttatcttccagccctgtctctcaggtgtaacagttgcagcttcaggagctgcagggaagcccctgcaaccctgctgttggcttgggggtggcaggattcggcttgccagtcaactgaggtgtgcagtccttacagaaagctgatgctggagaaggagctggctagcatgttgtggcgtattcgctgggaagaactgcagtttggcaactcagagcgttatcacaaaggtgcaggcagtcgcctcacactgtcgctggtgagcccttgtctcagctgttcctctgcctccctctgagttcctgtcccttcttaccctggatctctcccagcacattggcttgtaatgatagcccctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccgactctctgtgcccagctgagctcctgggtgcttccactgctctctagcatttccttgtacccagaacttctgatattcactttcctttcccctttcactcccaccatcagggaaatgttgtcgccatcaaacatgtgaataagaagcgcattgagctgacccggcaggttctgtttgaactcaaacatgtatgtaacagaggatggactctaacatgtatgtaatggaggagtggggaaaactatgaaatagtaaaattggctagatgggcaaggggttgatttataaatgattttaaaatcgtagatacaactaagagaaaggtcctcttatgtagtggtaagtttctgtatctaatttttaactctttcaattttcttatccttcccattgtttttttctgccagatgagagatgttcagttcaaccatctcactcgcttcattggcgcctgcatagaccctcccaacatttgcattgtcactgaatactgtcctcgtgggagtttacaggtgagggataggtgtaggagattatggcaggggtgggaaggatagacccaaagttatactgactctatgctgggtgatagctggtgggaccaggacagacagtctattccatgtcacttaccaggatattctagaaaatgacagcatcaacttggactggatgtttcgttattcactcattaatgaccttgttaaggtgagtcttccccactccttaaaagttcatccactttaaatcacttccactgttctttgattgtggtttttctccttctagtcctctgaagtcctgttctctcatctccccttattcccatggtctggtaataatgggtaaacaaggagtctggggcttataactgggacagtgagttttacctgccacaaggagtcctgtgcctgtagagagtttctatctttctgtcttaaatatctcaggtctctttccatcatctcttttacctctaagaactcataaaatgagtggagtctctgaacatatttttttttttttgagacgg

SEQ ID NO: 1576 - DNA, 417 bp, Homo sapiens
tgaacatatttatctcttgtttttcctctcattattttactctccgaacatatttatctcctgtttttcctctcattattttactctctgaccaatatttggcatgtctgcccttttgttcagaaaactgaaatttaaaaaaggaacatttactagtagaactaagagaaaccaaggaagattgtactaaaaacctttggtactcttctgttatactaggttttagctatgttcaaatgactcagaggcccatggatttgtggagcataaaatagaatcttgcatgagttggacaggttttctgaaataagtctcatagccaatgagcatcccagtggatcaccccacactgtatctgaaactagctttggttttctgctgaattctcatgaagttatttaaaaagtatttttttgt

SEQ ID NO: 1577 - DNA, 338 bp, Homo sapiens
ataaacataagacacgactcttgagagaacagtgatttggtggaaaagtgatttacaacaaagccagaagcctaatcctgtgattgttgaaggcatcctttgcacagtttccacacaagtaaattcacaacttcagagattcccaaaagttttgttgataccaaaataaataaaaaggaagaattcatagagattagagttatgaattaagtccagagctaaacatttagacagaaatgttttttgttagcatattgaaccttgtatcctctttctgtctcacctgaactgacttgggtggctcctagggtttcatttttggggagcatcattaagac

SEQ ID NO: 1578 - DNA, 3280 bp, Homo sapiens
tttaagactgtctttcagctcctcggaggcaaaggtttttccctctctggacccacagagccagcagttttaggcttctgcactggcttagcagattttgtccattttccaggtttatgatgttctgcactttctctctgatccagcattccctctagtagatcttgttcctcctctaccccgacttgcccacctccctctagtagatcttattcctcctctaccccgacctgcccacctccctctagtagatcttgttcttcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacttgcccacctacgcctggttatgcattaaagtttacaactggtcttccttggtatatccagctactcttgatacctgggtctcaagtcatgtcttcctaattagtagccaggtatctgaggccaccatgggtgttatatcattttggtcttcacccaagttctgttctcttcactaatcaagaagattgactgccctctccagggtagtcatttgtagctccacttatccctctttttaagcattttccctgtccctggtggctgggtgcctgtgtcctgcttatgataccaggaacagatgactcttctgttcttcctgcttccttgggtggaaactgcaaaggatgccttccaaaatcagcttattatttttgtggacccaagatctgtagacagctagccagtgcccatctcatggagagagggtattctaagccagatatgatccaatcccatgacttgatctgtaccctgcagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccagtgaggcccacccccacaacccactttttatattgctcctctttccacctagggatggtgggagagggaggtggagtgacagtaatatagggatgagcccaggtgggcttgggggtgccccatttcgggggacctggccagccggtttcctcttttcagagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaaggtaagagtcaatccactacccacagcctcttcttcctgggggaactctgttcttcatccaaacctttgatcaccctcagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaagtgagagggcattatggggcaggggcttcccagggatagaagactcattagtcctagtgcatgaagtggggcaggtgggaccagagggtgggttggataggaagtcctgggaatcttcagaatcttagagcaagtgccttatcctggcctccctctagggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccagtgagactttgtcccccttcctgtattttcttttgggattctgctctgttgggctctgcctcatcaggcacctgagaactcgcctccccaccctcagaaccctgctggccacagggagcacccctgcttatagattatttgctgtcattctgtctccacatcagctatgctgccttcttactggctgcccatcccttcttcttaagaccctgctctaccacacccttgcttcagcaagtgtatgtaaaacagtcccaacttgagacagctcccatgcacagggattcccctcaaacccccccgccacttgtgtgccttaccttgcattagactgtaatgtcttcccagccactttcctccctcccacctgaaaagcctagctttcttgttacagctcatctctgctgcagccacatacactttccctctctcttccactcctgctctcttggagtttggctcatacggcacccttgcttcctagttcagtggcagagcagttaaaacggggagagactgtacaggctgaggcctttgacagtgttaccatctacttcagtgacattgttggcttcacagcattgtcagcagagagcacccccatgcaggtgagagccatgggtgagaggtggcgggtggggttgggtgggtagggacctggggaagcctcattgataataggaaagatgagtttgttctagagttcccacatcttttgatggcttgtgggttaagaattcttagaaaattgggcacaagtctcagggcctctgcttttctatcccttttaggtagtgacacttcttaatgacctgtatacctgctttgatgccataattgacaactttgatgtctacaaggtgagagctggggccgctgttcaatagaagaccctttaatagagacccgctttgaaactcagtctccctgaaccccacacaccttacccaccccatgatcagttttccctccagggtactcagcatcctggtgctggagtgtacttcgtagacagatgtagctccagcactataattgtacactccagtcgaatttcttgtgaatcctttgacttccctaatcagaaccatcatgagatttagctcctatcttcctggagtataaatacagcctatccaacatttctctccagtcctctccagacatggaagaatcatataggatgtgggtccagactgatttagtggggtgagggaaaatatattttaaaaagtaaaactttttgttgaagttattgagttggatttattgtc

SEQ ID NO: 1579 - DNA, 95 bp, Homo sapiens
gattcgttgtatggaaagtacctaacattgtttggcatgtggcagactactatttagggataactactttatccctaaatacttagtgtgtattt

SEQ ID NO: 1580 - DNA, 162 bp, Homo sapiens
aatgcctgctttcctcctctctgacagtttgggctgtcaggtccatttcactgggcctgctttacctcctcaccagcctctgtcctcttgagttaccgttttcttgcttcccatttcctgatggcagagcctatttgtccatgtcctgctgcagacagggtg

SEQ ID NO: 1581 - DNA, 3085 bp, Homo sapiens
agacatctcctctcccctagactcaggaccatggcacttattttctagtcaatattctggtctccagcatgtcaggatgattaatgatggtgtcaagcttgtctccctctactttttcccatccccatggatataaatagaggtgaccttttaatccccctctcaatcaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttttctttgattcctcattccaccatcctccccattccacccaccccagcgctgaagatccatgtctcctctaccaccaaggatgccctagatgagctaggatgcttccagctagagcttcggggggatgtggaaatgaaggtgatggcaggccatggggaggggggcatggaaagggagggtgaaagtgattatgggaatcatagggaaagagagggagacaaagggactaacatcgaagcatctgaatcatgtccactctcccacttccagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcatagtgtgggataggggcaatcccaaggaaaggttatggggtatgcacacagtgactcacagaatcactaaattagcagtcttgggatgagagagaaccctttatgtaaagcctcttcaagtacagtgagaattaacttcctcccgacctctctagtgcagacagaaatagattccatattccataccccacttccctcctcacccctcagaaaggagtcattctcccccctccaccacccagccttcctccgggacagggaagggaagatatttctcccaattggtaggggtaattctcaggttcatagggcaaaagtttccccagagacaagggtactggtgttgagaagctgcagttcttccggaatggtgtgtccaatgtcctgatgttactgacaccctggaggagtgccaggatgaggatggatcccactctccccaagccagaacaaaacaactctgccctacctttcctgccccgctctgcccccaacacctagtcaccctcacacaccggcagctgtggtgccctctgtatccagaaggtctcaggttgctcctggcggtagtcgtgaggctgtgagggagggtactgagtaactcctggccttcagccctctctctcaacctctgggcttggtacttggccacagcctgtcagagcccagctggtgcaagtggcgggggatggggggtgggttctcacctttgttggggcaggagtccctgcttgtgccagctccattcggtagtcatggtgtgtcacagactcaacctcgaagagcttccttgtgggttcctgttctgcctgcacctctttactatgtagcccgaggggtgtcaaggccattctcacccaatttttctcctccccatccctcttcccctttacccaatcccttaccagatctgatgctgcaggagcatctccagcatggcttcacgcttccctgtgagagagttggggggtgggcaaggtggggtctggttaagaaggaggcccagaagaaactaacttgagaaaaggaagaagaaccttggggttccgcccttatatccactggagaatccacagccccaccagaaattccttcctcttcttccctctgagtaatgggctcgttctggcctaccctctcacatttcacacctcgaagtggccaatagacgtttcctggtggctggtacgagtctttctgggtggtgctggagggcatgggtgactttagttgcatagtcagcagtccccggtgtccgtgtcggaagaaaaaactctcagagccatcctgcatgcttgggacttgatccaggtggttggtggctctctgtggatcccaagttgaatgactataatatcccttctggtacccaccctcatgtaaactactgcctcccctaagaaactgagggcagccttcaagaaaagggagcaggccaaaactttaatacctcttcctcccagttgtagaggaggcactggccccgcggcaaagtttcatagcaaaccataagcttccctttaatgtctgggggtttccatagtcctcgggcacccggttctaagacttgcaaaaattcccaaggtggttgtttctggggctcccaggggcagtgctgactccaggaggtatagttagggacccgatctgccaccaggtttctgaaccctggaggaatacaggggctgagct

SEQ ID NO: 1582 - DNA, 215 bp, Homo sapiens
gattagaactatggtcagttgtagtgcaagtgtcctgagcaatacaggaaacatagacgggctcaaagccaagactcccatgggctatattgtgggtaaagccgggtcccgcacagggctccccaagaaggctggggtcagaggacggctccatgaactcagaacagggcgctggggtctttgtagataatgcagctgctttggcagtggtgaag

SEQ ID NO: 1583 - DNA, 4032 bp, Homo sapiens
cagggccgacctgggactgtcatctgaagaaggaaacggttccgaagtgggccccagtccttcggagctgggctgtatgtctaaagatctgaaagaaagcaaacacgacatggctgtcaaaagcgcagcagaggaagtcagctgaccttcctcgtccccttatgcctgcagccagagctgcggctctcaccgcgaccgcgaccgcgatccctccgtagactcgttggtctccatcttcagactccagctactgggttgccatagagacagcaaacaactcctggagcctgcgcagaagtacagctgggcggacttgcaggtggcggtggaggcaagtcctctgcggggcggaagtcttcagcctagtgctgttagggaggtccgctttccggtcccggcggcattccgcctcagacggggttttagggttccgctggcttaagacctcgccctccacgtccaaacagtctttgcgtgcggttttctaagatgatgctttatggggatatgttggaaacaggcacagggttgtggcattagattacagcctacttggtgtttgctgagaggcaagtagcttccccttagtttgcttagttcattctcaaaagtgagtggggtctttaacaaatgttaaggatgaaaataaacaaactagcttgagcaaaatggtgagacgtagaatagtgaaaaggcagccgcttttgtttgggtgtgattactcctcctctaataaaagaccctcatattgaccaccctcctcctaagcgcccttagaacctggtttgacctctgaagaagggccaggattggctttcagtttcttcctactcatttaggctcattcctactgttacttttctagaagcttgacctagggtggaccacttgtcaagaagacttacatatctgcaggcaacatttaaccacaggttggacctcctcagtgtctttcactcagaccagtcaaggggcatcatagccctgaatcagttttctttcccctttgtggtataaaattttatattaaagacaggagagcataattaagggagaacagttttattagcatcacagggtccatttttccctttccatccaagcatccagagtctggtgtcctttaatcagttggcaggttcaacctggaggccactggagctgccggcccccaagtacatgaatgtgcagatgatacacagattgtgcacccagcttcccatcgttgatcactgaaattgagcttggggttagggagtcaggatcatggcagaggtcgaagaatgaagatcatattgagaagtaggaatgagaattcataggtgagggaccaagggccaaaagtcactcaccaagtcggtatccatctcccaggccctcagcctttgctgtctgcttggccacaaggagtaggtgtcctagaagctatagagagagcggagggacataggtggcttcattcatagggagcaagacctctagctgggtccaggggctcctcccagccaaaccctggccctgttcttcccacctgctggtcttcttcttcagcctggctaatccgaggaatgggcttcttaggaatgaccaggaagtgcacaggagcctgaggggccacatcacggaacacaagacactgggggaagtgacaggccagaggccacgttacttcaacaggttggatggtatctacaacattcctaaggggataggtcctaagagcaccccacctgctggtcctcatagagaatgtcagctgggaggctcttgtccaggatccgggagaagatggttggggctgctcccccaggagttgcctgctgggccttggccacttcattcccatcagtcacacctgcagctcctcggacctgaaggtggatcgaccatattcaaaggagggagctggcagaagctgggctctgatagttgttaatttcgtccttctaataacctattcatcgttcccacccaggaggaaagttcctgaatttcagagcaccagcagcaaagggtagggccagaaggtgctggacctggttagataacaggcggtattattatcaggattcagcagtgcaattgattcctgctcatgtgtccacgaaatatagcactgtttagggaaaggatctagaatgagagactggggattttggtctcagttcctaccttaccataccactgaattacctcagataaattccttctctcagcttctaatataaaataaagggatggtttccataatctcttgcgatggcttgaatctctttccactctcaccttgttagtacatttccacttatttccgttacttgttttctgatctttaagccttgtcgcctgttttatttaagttttaatgcaatcgccctgtttgacactagttgacccctcatctgggtgtcacatgtgactctgtgaattttaactcttgtcccttgaatgagtggaggtaagagttcagctaagtgacctctgctcccctagccccagggaacttcgggtaagggattcagagaaggctgatgtcattgcatcacgttgggggagaacgggacggaatgaattctctgacctccgagccgcttctggcaagtgcagaagagaggttaacactagtgctcattaggaggccagaagcctgaggagggcagagcactggctccaagaagagaaagctcatttcctgcagggggcatcgggccagctgggctgcaggcagtggaaagaaggcggcagccgctgcactgaccctgtcccgacctcggcgccccggcctgcgcagggcgggaatcagcaccagctcgttctccggagccaccagttcgacctcaccacacagccccggagcttgtgcctcggaggggcagaggccacaggcaggagctctgcgcggctctgcgcgccttcgggaccccctggccccggatggcttcggagcccgcaggaccccctactcgctcccgcgccacttctcacctgccccccgcgcacccccgtggccgccacggctctgcgcgccgcgcgcaacccagcagccagcaccacggctgccgccatcttccctgagccgcgggaacctctcacccgggtcagcactcggctccgcggccggccgtgggtggggactccgggcgcggggaagcggggtagtggcggccgggcgagccctgctaccccattggagcgcgcctctgagcacgattcaccccattgcctctgcagccactttggaggcgggctcttttcatctcattggctgcttctaccaacgcgaggacaattttccattccattggtttcgtcttctagtccgtgtgaacgttcttttcccattggatccccttactagtttctctgtgagagaaacttccactccattggaaggattaatggagcctggaggtgggattttctcctagttgaatctgatacacaactctggcttctaggttgcggctcccgagtgggtggttcttttcgttcttggttcgtcctcttcaggtctggttcctattggtgcgcggggagaagggggcggggctccgccacctgctgcagaaagggctgttttagaccctctcaccgctttggccaggaggagggcggggctctgagggcatccggcgcttattggctccaagaaccacccggggtggggctaaaggtgaacggggatgaggtgtgtttttttgtgtttgtttgtttgttttaactggcggggctgatgcgcagcattttctccacaagggcagtttcagtcccttgagcattttggagattttaatgtacttatctaagggaaattcttccttaattctatgttcttgttaacgcattcactccatagattaaaaagtctgtggtttttgcattttttttttttgagcaggaggagataagagtgtcctatatttgccgcacaagaattataataagcaaaggagtatgtattcattgttcttttctaatcggaaaaggtgtgtgatacagttagctcggtgcctggtgttttctttttttttc

SEQ ID NO: 1584 - DNA, 135 bp, Homo sapiens
aataagtcaggtttgcactgctggaatatatatttttgacataagaaacgtggggtcacaaaatactaatattctcagacgctaggtaagttttagtctgatatcacataggacaagttaccactgtttctttgg

SEQ ID NO: 1585 - DNA, 220 bp, Homo sapiens
catttggtgtttcctgtctttttttcataatatgtaatatgtattgcatatgatactaacccatgtgtaatcaatttttcatatttttacagtctacgtaaatatagtttgtattggctgcttattatttccttcaatgagtttatcatagtaatcctaactctattgttgactattagttgaattagttttaggtgaatggttatcatggggcatataa

SEQ ID NO: 1586 - DNA, 811 bp, Homo sapiens
cagtccagattgcattccttcccttggaggaacagatggcccccctaattgtgaggaaatgtagaatggcctcttctctgggccccagaggctgcagttctctgtggtgcctctgggacactgggagaccctagagttgccctggagaagggcgagagataagtggatctgggatctaggaagaggaaggaagccagtctggaggataggtggatacaaagcactttgaaattagttatttctttggttctcatagaaagtaggcaacacagaggttattcctgttttacaggtccagaaactcagcctaaagagggacagtgacttgcctgggttcacagagcccattagtgctggaatctcctactcccataagaacctatggactcccttgtgacttcccacattcactgattttgatccttggcccacagttttctctacttcaagcacttatcaccttcacttgccctcatctgaaagatgttatgctctgcagcctctgaacactgtctcttgtactccaacccctgcccctacgtctgctactgtacctcattagagacttctcttcctttgactgctccctttttcaatctgtcatttgcctcctggcatcactttctttccctattggtgctgtatgctcccttcacatcctcatgccttcttttgcttagttttcctgatcttcctccctgacaccctcacatcatcaacccattaaatatttggattctctgcttctctaactaggttctcacttccaactgtgcccgaatcctgaactacccactgatgaggtttttct

SEQ ID NO: 1587 - DNA, 1212 bp, Homo sapiens
caacaggcagcttgaatgtgagtgtgatggaggcagatggccagatccaggctttctcctgtgtctaataggtgtcaactctaagttattaggcagtctctccctgggctgggatctacctgccccatatagagccaagtcaggttccaatgactcctcttttattgctgatctgggccagactcacaaaggcctgtgccagttgctgacagtgtctgtccctggaggaagaaagagcagaggtgaaagggtcaggtatgggggtcagaagggaggccaggctggagaccgtgtgaaccagggagccccgggggactagggtgggagctgggaaggccagagggcccctgtatctgcagggcctagaagtcagagttgctgaggatggcttctcggagcacagccatctctgcaaaaggtacatagtctgctcctgggggtgaaaaccagtgcagatgtgggatgcaggtaggtgggtggtggggaggtgggctgagggagcgcgctagtcctggaagggatggttgaggatgggagtgccttcctgcctggccttctgactacagaccctggaatggccccctgtcccaggtttctgcctcaccgcgaggccttcctcctcgttgccgggtcttctgggtgtcaaagaaagtctcgtgttcctcccagcgccggtcacaggccgcacagaggaaattagactcaaaacagccgcagcaacagcctggggcaaaagtgcagccaagaagagtttaggaaatggtggtatccccaggagctgaccacattctcatctcttcctcagtgaccgcatgcccaaggctctcatacctgctctccatcattatccccagattgcatcctatccccacctaccctgctcccaatacacctcttgccctagaagttaccatgatgcctgcagggatggggcccagtggctgcatgttcttcgtggctgtgtttgcagcgacattgggccctccaggccttggggtcaaaggtggcccgtctcttgagccagaactcacccacctcctctgggcgtgatgggataaagcagaacatgaagcagcggcactggcttaccttgcagggcaccgatatgtctgtgggattggggatggatggtagggttaatctgataggaccttgccttctcatgccaaccccatcctccatccccaccaccccctatgcacgcagacatgc

SEQ ID NO: 1588 - DNA, 1233 bp, Homo sapiens
gtgagccaccgtgcccagccacatgctctctctcatacttcccaagacatgacagagtacagttattcctccacactcgagaggggctggtcagttctcccctacctgagatgatccggtgctctctcaacaagtgtccacaaaagcatctggactcatccccaatccggaaacagtcccataggtaatgggggcagcgccagccaatgtagagacctaggtatgcaggattaaaagtgagaagtaaaaaaattctaagctcccccgaagtgttcttacctatcccttgatggaggtgagggggtggggggaacttacctctccccacccccaggtatctttatctccacctggaagtcctcacctctaccccttagattttctttttcctcagggttttctcattaccccagaagtgtcttcagttctcttcctacccaggatctactccatctttgtcagcctgccagagatgactcaagagagtggtttctgagcaggaagattatagatgaaattttgtttgaggatgaacatgaatctcactgagttctctgtgaccacagggattctcatctcctctcctcatcccactaaagcccaactttgctttgttttcttgaagtgtctaaggtgagggaaagggaagatgattggccagatgtacagacaatgggattggctcctaaggagcatatttattgaaggtcctgaagaggagaaggaggttggatagctctggtgctggaaggtaggaggagggcttcctctcacgtctccacgttggtaccttaatacctccctctgtgttcctggtgctattgtaccaatgctctctgtgtacctaagaagggctgccaaaggttcttcaagggtcaggagaaaggggtaggtagcagtcatgagtggtgaagaccaaaaattatatattttgaggctaagcaaggaggcgtggaaaggaaagtgaggctaagaagtgtccctgagagtaggcaccagcaagaggtcacaaccctcgagagctggtgttcagcagtgaggtctgaatccctggcttcgtgactagtcttgaggtgagggtggtgctgtgcaactgagggaggataaccagatggcacctccaattcagattttctcattctccatgagaactgagagtaccccaacttctagccaagaatcctgtatgaggccccatgcagtgggactgccaggtgtaggattcttagtccc

SEQ ID NO: 1589 - DNA, 1431 bp, Homo sapiens
ccagctcagtgccacttcgttaccgcaactttgctgtttttcacttattttgccagggtaagcacctaagttagagagaaatgttttttcgtgacgaggccccacagagttgagaatgaacacatcctcccgctccagtttctccccagaatgttctgccaaggacccaggccatagaggcatcctgggctgacacctgtgggggccctattatacccccagcgctgacaagcacttcggcatcctgtaccacattttcgcgttactctcccctgtctcatcccatcagaaaagaggagccaagaacatggctaggactcaccacctccttgagggatggggactgttgcaaaattcaacagacgtgcatcagccgcaggctgggagaccagcagagaccaaagcctgccagccccactccctgagcctctgaccagactgtccctccccgtgtttgcacctcttctggacacaggaagtggtcaaggccttgaccctttgagggatgccaggcccctgcgcagtgacaccctcgcggtggtggatgcctgaaaccccacccctagagaggccgtcctgtggtttctgccctggaacactggaaaaatgcagattcatttttccctagacagcttcagtcctaccagccacagatccctctaagtgagttgtctgaccctttcctgggggcagattttgggtttgggggaagacagacccactacatgagggagcctgagtggtctttgggagaaaggttagaaggaaagaggggcttggttccctaggaccagctccctggaggttgccccgtatcagctgccttcagccttgccttaaaacccactccctggccaggaccccgttcttctaaggattgcgttctggcttagggctgcatgcaggcaaacatgggagcctgagaatgggctctgcaaaggagcagtaatgggttgagggtctcctgacaggtcccacagccatgccctggctgagaaggatcgagaaagagcagggaggctgggttggagtttggacagctaaccctgggggcaggaaaattgtgtccctcctctggccctcctgaggctgaaggaagtccaaatccgctgtggtgtacaatttggcatttggggaaggacccaaaagggattcttttctgccctgagcagaccttccccacactgccacatccaggggtcttggcacagaggggacactgtggccgtcagagactctccgctcaatttccatcttctctcattcatccacacccacccttccagagctctacactgcatttctaaagaaagggagaaactcgagtgagaactagagggcttcactgagctcattattatccccgacaagacttctaaataatctagcctttccctgtttgaagcatgagaggtgtaagcagatttattc

SEQ ID NO: 1590 - DNA, 958 bp, Homo sapiens
gataagaaaagaaagaaggtagtctcacagcactggaagtcagaaaactattttcctttccagaatcctgactcactccaatcccgggcaaggtcattctcagggtctcaaaatcacattgcgatgcctgtgcctctgccaccttctacactgccccctgagatgaatgcaccatcactgtgaattactaggcaaaatcttctccaagtggacaatgctgtatgttcattcctccttgcaatccccatgactgcattagcaaaggagccccgctgaggctgagtagggctgacacttgcctgcaggtgggcaggtccccatcagcactggccctacttccaggactggcctaggagaggccagggataggaatggggactgtttagatcggggccgacttggaggattttttcctcctgcttattaaatgttaaaggtttgacttggcaggcaatcaggagcccaaaatatcataaaagggaaaaaagttgccgagtggctaagaggtgcaccacgggagtgtcactgggcccgccggcgaggtgaattgctaagcagagagcagtgaacggggaggaaatggagcagcagacattttcaaaggcttctctccccttcttctcctctctctgtcccccatgcggaaaggggaaaatagaagtagaatccagattggggcgcgtggctgatttggtcctcctcccgcaccatcctcccccagacagcagagaaactttgatgtctgggtgcatggcattcagggacagaggagcctgggcatcccagcaaatgcagccgcatgttccgcctctggacggcctctctgaactcctttgtgaggggagatgaagcccacagagctggaaagagcagcgttttgaaatgaggaagtgtggatcggcattccttgagctcagtgctagccaccttggcgatggggtgagccaaccaggagctc

SEQ ID NO: 1591 - DNA, 242 bp, Homo sapiens
ggaagtggaacttcaaacagcaccaggggttggaacttttgtttcaaatcctctctgcctcatccccacccactgcccagcaactcaaggctgggtctttcgccccctcaggctcagaagggctgtggcccagccacagagccagggggcctcctcagtagtattggccttcacactcttggtgctaaagttctccagttacttttttattaaaccaacatgtacagaaaaactcagttttc

SEQ ID NO: 1592 - DNA, 150 bp, Homo sapiens
tggagggaaaccctgataccacttctgggtccagatggctgtggctggaatgcggccacagccaggaacagcgtggtacggataccagtggggctctggtcttttcccagaggctggcacctttcatgccgagttgggcctcgggtctcg

SEQ ID NO: 1593 - DNA, 124 bp, Homo sapiens
gcagtgcaaagggaaccttcccaacaaagtaagagccaaaggctaagatggcagtctgtggtttgtagaaccttctagaagaccacgagacttggtaagctgagcttctaagtggtccaggatg

SEQ ID NO: 1594 - DNA, 168 bp, Homo sapiens
cctgtgggggtctgcactcccccaggagaaccctcatgtctagggagcactccatggggtcatctccatgcctgagaggaccctctcttccttctttcaaccttccggagcccagcttgtctcttccggccaggtcaaggtatcctcctgagagaaccgtgaaataca

SEQ ID NO: 1595 - DNA, 786 bp, Homo sapiens
cctggtgagccacctaccctcttgggcatttagttgtctatcagtaaactagatcattaacactgcgcctgcccctcctgctcacgggcacgttaggaacatgcgcttggataaaatccaagccagagatttagaaaccagtgtgtggtgccagctctcagccttggaaccacaagcccatttttcttaaaaagggatctggactggcatccaaagagatttcagtcccctcatataggtttaaccaccatgggcaaggcagtctctctcccaggtattcctctcactaggtgctctgctctagaaatgaagtctaaaagcagccccatcaatacagaacagagttagaaccacccggagagatttaatctggaatcccagcaagttgtgaaatggaaagactagtcggccagagagctgaggtctcacagtgtgcaaagaccagtcctcagtatctgcacccatccatttgagtttcaggtgaagcctaggatttgggagctcaatacaaagatgccagcatgaaggagggtgggtgccaactaggtttggatttagagacatcctccttttgggaaaggaaaatatcctgattccacttaggtttccaggaagaaggcatccccatttcagaacagttttctaagccaccctcatggaggtttcacctgcagctttcagtctgctttgtctgatgtttgaggatgcaactgcccaaaaatgggtctaaagtagcatcccgtcacgttctgtaaaaagtaatactgctttaaggtaacacttatg

SEQ ID NO: 1596 - DNA, 1055 bp, Homo sapiens
gtcagtttggatgaagttgcctcaaatagagtctaaatataagatttcatactcgatagtgtcatttcaggatcaggaaaaattaggtgactcccatttggtttctacagcttttccccaatatcatgttaaagttttggcttttatcttatttcacttatttcattttgagtcatgtcttctggctccagctcagcttcctagagataattcattaggcccgagagctgctccagagtgggattagaacccgtgtagtacatagtcacattaaactgagatcggctaattaatcgctcttctccgtgtaactgagcgatcgcgctccttccccgaggaattgcaatttcatggttcctaatgatggtgcgattacattatgtggatcacttaggctgtgggtgtcaggagcggtacttggagcctctctcggtggggatgggagaagtcacttctaaaaccggggagatggaggaaagcagttagaatgtctgttactaatttttgttaacgtgctgctgtttcctacatctcattcaggcattagtttcaagttccattttcccccagcaccgtgtggcaccttccccagaaccctcacattttttttctaatattcacagggttattgtttgtaaaaaatctatttatttgctttattccatcaagtaatttattttcatgagatttcttggaaatgtggctctacatatcgttagtacaagtaatacattttgattgttgtttcctggaataacttgtattatttgatgagttaaataaaatgcctaattctaaagtcggctattcccatcttttccatttgaattctttcacttacttccatttcctttctaattgaaggttagttcaaaatcttcagttcagtgctctgctacagtttttggactgtgaattagacgctgtcatttttttaaatgatgaaacttggaaagataatattcaaggttgtttttgaatgcaggtttttatttttctttaatttcccaaaaatatggcattacagagcaatcacagacttggatctgagctct

SEQ ID NO: 1597 - DNA, 188 bp, Homo sapiens
cgccgtggaaaacacccccaggcatgtgacaaaccatcacactcatcatgactaaatgtgttgctcagtaacatggcagacaaatattgcttggggggttgttggtgtttagggttttttgtgtatgtgcagagtcctcatgattctgggcttcagatacctaaagaatgccttaattccatactgta

SEQ ID NO: 1598 - DNA, 42 bp, Homo sapiens
tgtggaagaacaccttaatggtagaaagatatttatttctcc

SEQ ID NO: 1599 - DNA, 299 bp, Homo sapiens
aacaaaccacacacacataagaataaatattagacatggcaccaggatcatgaaggcagcatttgaaccacaaaactgagtctctgccttccccagagcccaagggtactaagggacacccagcagttctctggcaattaactgctgtaggagttcagtcacagagagacctggaaagataaggcaggcagtcttggtcgcttatgctggtttgagcctacctaatgtccagcatacagtatcctgaaggaaatttgaggacacatttgaaacattgatttttaaaaatctattgattg

SEQ ID NO: 1600 - DNA, 108 bp, Homo sapiens
ggatcactgtgtggttcttaaataatccactgctgaggggcaattaaaagggaagtagagaagaaataactcacctgtgctctcccaggaacactggtagaatcctag

SEQ ID NO: 1601 - DNA, 409 bp, Homo sapiens
ttggctagctctttctacctgccctgtctcaggttacatacaccatcacagaagccttccctgaaccttcctccaatctcaagaaggtccacctgattcttgctcatcctacgtttttccttatcataatacatactcaagtatttattcctgtgtttattctttcgtgtccatcatccacgttatgtggatcacttaggctgtgggtgtcaggagcagtactcagagcctgtaccagggaccaggagaaatcactcctaaaaccgaggagatggagaaaacagttggaatgtctgtcactaattttcattaacatgctgctgtttcctccatctcaggcattagcttcaagttccacattttcccccagctccatgtggcaccttccctaaaaccctcatatatatat

SEQ ID NO: 1602 - DNA, 1334 bp, Homo sapiens
ggagagaacttctattatttcagacaacctgctcagccaaaacttcaccaccagcaagttctctgttaattatcgtttgtccccatccaaaagcctgagcactgtgcatggtgtgggagagaagacacgtgggatccactttcctcctggacaagaggtggggctgggaagaggcgctgggccatcggccacacctgagctaatattcctggcgcatcaggtgcttctcaagtgtttgtggacagacggctgccttggatgaaatggtattcaccaggcgtgtccttttactgtccagtttggtcaccaagattctcccctattttaagagggagctgagcagcttcacaaggctagtcttgtttggatgcgtagcacaatgaatttgtacccgccgagcctccagcgctggtatttcaaaacctacagtacactaaacgtaaaacttttgttcaaatttcaaggattttgatagcccaagtgaatagacactgcctattgatttttcccttacaatgactcttggataacctattttctcatttatttttaaagacagctcaggagatttcatagcaattctgcctaacctcctaatatcaaaatccctccttgaccctgaaaattgtaattctgctatagatcacagctgctgaatattaccttttactaagatggttaaataaaatatgtccaaatcactagatcccacaagccatgcgctgcaagtctaatgatccagaggctgaggtttcggccgctgtacactcagcagccccgcgctcttgccggccgacaccacagtgtgggaatcgagaatatcggcttcggcttggaatttaaggaggaggagagaaaaaggatagctcggctggtcttcaatgattttcttgtaaaacttttacaagggagacttaggctgtttgatgtgttctagacaatcaaatgcccgccgagtctgcggcagagagtggctggttttctccctagtggaggagggggtgtattttgatgtagggcaagttcaaaacccccaaagccttgcacgctggtaggtcggattacactcgcaagctgggggaaaatacaacacgtaaaatgtgaaaaagacctctgaccctgaaagtctcattctgcccaggccagggctgttagtgggctcttagttaggctggagagggcctgggtatcatttaccccatggaggcttctgccctgcctgcaccccgtcgggcccctatgcattcctgctctcacctgcacttcatccattttagccaaaggggccctgcccaccaagctgcccagcagcgcatccacatcagacttacttc

SEQ ID NO: 1603 - DNA, 466 bp, Homo sapiens
tttcagactgtcctcttcccttacctgggtggcccctgcatccaatatggaaatgtttcccagagaatctcactcattataggtgagcggagcctgaaatgactcattcagcagaaatgtggcctctctcagcagtggccacgggagcccatttgaaatgcaagaggctcctctgtgggcctgccaagctctgtaactcagctccctcccagccctggccctgcagtaattctgctagacctggtgcctccccttgcagggtaggcagtggggctttggcaggtgatgggtccatggaatagatgcaaaggtctgctgataccagcaccagttgggtctgagtgagcaggaaactgtccatgaaaaacaaattaatcgatagcagagtcctcccccagccctggtcaagacctgtcagtggatcagaagagttcacatgttaccatgctttaagcacaccttatgc

SEQ ID NO: 1604 - DNA, 238 bp, Homo sapiens
tcctctcagcatctcctgcagcctctactcatcagaaagagtggagttagggcatgcaatctatctaacccctagcatcccatgtcccacatcccacatcacctgcatacctcttcccctacatagagcatcctcatacccctctccagtaccctgcctactccttcaaggttccacccagtccctgttttcctgaccatcattctcttccctgcctcgccagccactaaggaaccaa

SEQ ID NO: 1605 - DNA, 61 bp, Homo sapiens
gcaaatacctttgcagctatcccactctttgagccatttattatggcccttagtcatttct

SEQ ID NO: 1606 - DNA, 268 bp, Homo sapiens
ggggctgacactctatttctccttggggcatcaaagtgctgggaggcagaggactcagggcctactggtgccatgttcaatccctgtggcattgatctttagctcccaaagaaggagtatccttagaaaaatgcagtaacttcaaattaagcattgttcaaaggggctgactccatcttctatccctccaaagggcttctgagccacttcggagctcaggaccgtgagccaatgagagacaagagaggtggcagaggctcaggaccac

SEQ ID NO: 1607 - DNA, 2107 bp, Homo sapiens
atcacagccctcaccaaggccaccagcctcgaccagcccacacccccgccccagtctctggtctgttcatgagacattacccatgggagcttgttctcttagttcaagtgagctgatgcctgctctgtgccagccactagtctaggaatacggatgggaataagcaattcttggctagaaagaggagttgagaacatcaagagcacaaaccagatgaggccaaacaaggaggtcccaattctgacagtcagatgggatgcttcccaaagagacaccatccctaaccccctaccaacctgtgattggttccatgcaaagaaccctctcatggtacagcagaccctccgcccagtggacagtgccacctgccctggggagaatgcaagccaccaggcaataaatttcagctcttgttaccacctctccattctcctccatcgctccctcttgatctcccctctctgctgacaacaagatatggctggcatttagttgaggatttaaaatcaggaaagcttctccctaccttcaggctggaagctcgctcccctggctctctgaggcctcttgaagccgggcgtttgctgagtgccaggagaccagctcctgaaaccggaaggggcctgcattgttggactaaaatagcaaatgtgcaacatgagtctcttcaggggccttcagcgggctggcagcttccggtgggtactctacacaggccacagggaagcaaactggagtggccctccctgccacttgagagagcccttctatgtacatgactgttctgtcccttagctagattagttcatccaactgaaaatggactttagctgtgcctagcaaaaaagaaaaaaaaatggcatgtctgagtcaaataaagcatgcttagacacagggcccgtgcgcttctcgactgacataaatctcatctggggcttgctgccctggatctcccaggacaaaagagacctcccaaagccaaaaggagccctctctcatggatggcagccacaccctgacccatgaggccagaacacggagccccagaatgtcgcttctcctccccggtggcagtcaattgattacttgtcagtttccaaaatggtctcatctccagaagaaacaatgcacgaaaaagcagttctgaaaagagaattaagagcttgttagacacgggcctcaggtcaggataggtggcctatctggggggccttcgaggaggcatgctgcgattgtttttaagccagccctctcccctgcagttctcgcttaatgaagctgctgtacaagccccttggagggcccgcatactgcaaagtagtgccaagtgtcccgttactgtaaacggccttttatttttaaactaatgctatatttggaaagcagtaatcctggggaaatgatactgggactaatggggaacatattacctttcatgtgtttttttcatgtttaaggtttctttgttattatctgagtagcaaggctctgcacacactcttgggcaaaaaatcaaaataagccttaaagcaataatattttaataagcatcaaatgtcttcaatgagataaaagtattatatggtgttttgatattgggctttagttaaaacctcattaaaaaaagaaaatttctcagatatattggggtagggggggcagtaatgtatttttaaattcaggtggagaaaaagttccagttcaggtcaattatgctaattaaatgccacaaatgactgaaattgcccgcaaatggacattattatttgttgctttcactgcttcccattgatcaaaaacagcagctaatgacatttgagcctgcaaaggccaaagctccagtctgaataaacatcggctgcctggacaccaatcacagcccttggggtgggagaactaagctcttgtccagcttgcgtccagccctgtcctcttcccgggtgaggtttccaacagccgaggcggcagtcacctctctgaagctcagattagtttcgtcaatgaatgcttggtcctgttcccagccccaactgggaagtgctggggggtgcaagttatgaaatgaaactaagtctttgatttcttcacccatggccagagacccagc

SEQ ID NO: 1608 - DNA, 562 bp, Homo sapiens
tcctctccaatattgtaatataaaagagaacttcaactttccctccgctacctcatagcaaatttccctccgttttctcttgtaactgcatgtcaaatcttagttgggggcttcagcacaaactaacctgactccaagattggaatcaggccacgtgtagtagcacttgaatctgtcttctcctctggttgacctaaaaggggagtctaatttcagttacaaaatgaaatgcagttgactgtggatggatgggacattggagcatgatgcggcggggagggggtatggaatccgtggtttcaggcccatctgtgaactctatgatcctgactttatctcctgagctaaagtagaaaccatactccaagctgctaccagtcgtttctacctcaaggtaaataaaccatctcggaagaatgcagtggcttcaagttaaacattgttcaaaggaattgactccatcttctatccctccaaggatcttcagagccacttcggagctcaggactgtgagccaatagtgcaggagaaggagtcaaaggagatcaaaatcctgggaagg

SEQ ID NO: 1609 - DNA, 193 bp, Homo sapiens
tcctgggagggggaggggatagaagactggaggatgggtggttaaggatgtcacagtgacccaccgatgtggatcctgaaggccatgacccctgcttttcctcagcctgcttgatttccaggcgtggttgcgtgggaaccctcccccacagctcaatcagagctgcagctgacatgaagacagccctaccctc

SEQ ID NO: 1610 - DNA, 259 bp, Homo sapiens
taggttgaatggctccccaggaacagttcctgggtcttgggaacatagagcaggcagccaagtccctagagatatacaggtaattcctagccacaggtaatcctgaagtcctatttgggctttatagggagagtctggggatgtctttgaagtgccagggtcagatcaactatctgaatttggtttgcctcacagtcatgaaatgaaaccacttttgggtaacagtagaaaaggggagggagggagtacccagctcaat

SEQ ID NO: 1611 - DNA, 706 bp, Homo sapiens
catggcactattcaggaccgaggccagtgtgaaggcccaggcacacagctcaatgtcctggcctggtactgagtgcttctccctctgcccacgtggcctgggaggaaaagaccccaagagggctggggccaagcccgcaaggcaggtgctccccactgctctgtgtattctgctcccaagacagccccaggtggctggggccaatccccagggagggcctgggacagacctcgggtcctcctggggtcagagccagagactactgcaggtggctgctagggggtcccagggacctgggagcagagccttctgcacagactgggcaaacaccagtacatgtgcctgaagggaagcaaatttgagttactgaaaagtaaaaagtgcttattgagctgcacattatgtcatatatggtgtagattacaactgggaatgatcctgtatcagattttttccccctagactaatttgtatttcatgtgtccagtattttattgaaagcatcaggacaccccctcttcttagtaacatagggcaggaagggagtaggcaggacgggaaggaactcagagacccttcactgcccttgcctgtgggtaccaggtgacttgaagggcaagaacgggggcacagaagacgctggaggggcaggggggtggcagagaaggagcaggcctcggtcaccgggcagctcactgcgcttcca

SEQ ID NO: 1612 - DNA, 273 bp, Homo sapiens
ccagtcagtcccgcagcctgcagagtttgcagctgatgcaagaacgccactttcttccctgagggctgctggctgggtcacctcgcagctcagcccaaggagggggccatgggcagctactgaggctggttctgctggttgcccctcccttgctcactggtcagggatggagctggagccttgtctcaagagcaggaagagcagacactggggatggagtcgaaactcactcattcatccattcacagggtatttcctgagccctggcagggc

SEQ ID NO: 1613 - DNA, 343 bp, Homo sapiens
atgccatctgagctttttaaggactgctggctggttgggagggttggggggagcatagatgaaaggggggacaaacatggaatcagagagacaagggtgggctcttggggttgatcccaagtgctccccgctgccccaaagggcgattctgagttaggggcactgctgctggtgggcagcccaggagtctttccttctcactgcacccctactcctacctccactccagtccccctcccccatcatgatttgccagacctagcaccctaaggcaaagcagggccacttccctctcaggagggaggagcgcctaccatcctgctgtcaatgggaccatctccat

SEQ ID NO: 1614 - DNA, 112 bp, Homo sapiens
acattcctggacatctttgggcctcagtttcctcatctgtaagttggacagctgtgaggataaagagctgagagactggatacacaaatggaggagggccaggctgtatata

SEQ ID NO: 1615 - DNA, 290 bp, Homo sapiens
atgccgaggcatgaaaagctcctactgcttccctagcactcaacaggtgcttagtgaggttctgtccctacccattgagaccccctgggcagctgccccactgcctgcttgcccaagagtttccaaaccctgagctgtgaggtaggcacaggtgccctaagaattggctggttcccagaacaactagacccctggggggaaagtgagcctaataaaattctgtatttctttatgtatggtattgagggggtgggattagggagaggctatattttggggaaggaggccac

SEQ ID NO: 1616 - DNA, 929 bp, Homo sapiens
ccatgctagctcttggccttgggtgacagttgtcttagttgttaagcggagaagactaaatgagctaattggggttagatgcttagcacgacacctgccatctaggacatgtgccttcaacagaaactagcagccagaagtggtggtgataatgtgcggccatctcagccagcaccaaagtgagaggccaaaggttcagaaaactgttcaggaggatgcatgtaggcacaccccccagagcgaaccactttctggagtcctcagcgcactagcttcaccccagggctttcctaggggatactaaagacactgcgggactcctgggatctgcagctgtgaccctctccccaactaggcccccacctcagtggaagcaaaggtagtttcccaaagggctaacagggtaagtgacattctatcacaaggtgtgggtcccaaaaccattagtgcatcatcccatgtatgaaggctagatgagggtgttctggaaaacaaccgaattgctgttcatccatacttagtctttatattttaataggaggcaaagccctgagtccagagaaactctattaatgtaggctttcaggcagtttggatacaaagaaattacccttgattgagagaagaggggcgttgggagccacaccaccaagatggtgcaaggggcattggtcatgcagctggccaacatcagagcccactagaggaccctcttgctgccagggaccagggaaagtgggcgtctgaatctggagctgtcatcacaaaatagaaaggtggtgaagaattcattccagccctgcccatggcagtcacagccactttcagaggagcagcaccagatgtggggtgcggcactctatggtgggggcagtgggagctcagtcaccagggtttggcagcatccccggtggcatccactgagtagg

SEQ ID NO: 1617 - DNA, 169 bp, Homo sapiens
ccagtggcttgccactaggaatctgctctgatgcagcccacaagcccaaggccggtggaggcaagagaatgattacaaaaagcaagcaacatagttgattttaatttcatgacatggtttccaacaattggatacagaaacaaggagttcttttcttttttttttttcc

SEQ ID NO: 1618 - DNA, 322 bp, Homo sapiens
gcagaaacaaggagttctttaaaatgagatgcctgttaccagatggaaaagtgatagggtttccacagtagggttaggattagggaaatgtggcttacatattctcatgctttcatgagacctgccccaccctgcttcccccatcctggggaggctggagaactcatctctgatcactcaccttggcttcccattacagccaggtgtttactagctcacatcaaagtagccagcctgccatgggacacatttcagcttggctgtgccttgcttacaagatcacatgaatctccttatttgagatcctgaggtccaaggatga

SEQ ID NO: 1619 - DNA, 182 bp, Homo sapiens
tgattatttggcagtctccctgtcattgcttccttttctgcactccgtgtaggtggatcacagacataacacagaaaacggggagcaaatgcagcaagcatccacctttcatgtttggcaacatggagaatatccatcttgcaaccaagttctgttccctgcccttaaggtgttaatggaac

SEQ ID NO: 1620 - DNA, 134 bp, Homo sapiens
gccagagactggtgatttacgggagctcacccagaagctgcaaagaacccagcagtctcagtggtggctgcagccaccaacctcaacagctggaagcaccagagcatgcgattctcaaggctttgggttttacc

SEQ ID NO: 1621 - DNA, 498 bp, Homo sapiens
tttgaggctgtatataggatgagcaggaaaaggtggtacgactgattagcaatgcctgtcatgggtgtggaattaatgtgaggaatcgtatgcaacacacttgcactcctgctctaaactgatgattggaaagttctctaaagtgactgctaacagcgtttatttcttttgtccctgagtcaaacatatacgttgtaaccatctatgtgtggagttaacacccataaacctggtgctcaagagggacctcagaattagagcagctaatgaaaaacagggcaggaacattgaggaagccgtgggggtctccagcctcctggaactctgctcttcacagtccacacagtcacgttcctcaaggtcatcatgtggtcagctctttcataaccacccccaatcccctgtccttatctcatttcacttctaagcttccaggcccagctcctccaggcctaccacgtgatcttagagaagccttcccccaccccatctccagtt

SEQ ID NO: 1622 - DNA, 94 bp, Homo sapiens
ccatggtttgcagactgtgtgcccaggagccctggggtgttcaggaggaggaaggttagaggaatgccaaggcatagggctttgagaggcatta

SEQ ID NO: 1623 - DNA, 284 bp, Homo sapiens
ttaaaggctcaagaacctctggataaacaaaaggcccccctggagtccttccagatataccattctctggtgctgcttgttttgtctccctctaaaacaccagctcttcttctctttccacttcctttcctcatttcttttcccatcccctgtcttccaaagaaatgagttgcaaatctccatcttaacttccaaacttgagttgagaaccaaacatgaagcctggatcttttcattatgagaggctctgaggtcatggaaaggagaaggggacgataaagcca

SEQ ID NO: 1624 - DNA, 1038 bp, Homo sapiens
gtgtaatccttttttataattgaaaatcacattgaaccatggaaaatgtagtttgacatcctagagttgagagatattcaccctttccctcctcttaactgtgcagcgcaaaatttcgagaaatgagaacatgctgctttgagttgttgtttttaatgtcactgcgatgactggacagtttttattattgttggcaagaaaaggcaggaggaaccattcacatagggttttctgctcaaaatgtactttggagttccatcttggggaataggaacccttctgttcctcttcccgctgcagtttcaccgaggtcccactgatgtcaactccagaggactatgaccgtgtcagccgtaaaatatgtcggttcgggaagaggacaagttcattttcattattccctggcggagagaaagggcagagttggtgtgaggcctgggagggcgtgtttgaagaatggtggcccgagtccaccattccacgcctgctctgcggggtcctctggctggggtcttgcctggacgtggcagaaacccgcacccaacggcctttctctgcacaagttggggcaggacggccaggcagacacagagcatgcacagacctcgcctgctgattggctgaatcctgggggcagcacattctcccattggctgttccaggttggcacaggtggctggagagggcggggcttgtggtccgcaaatccacctgtctcacctgttctctggttcccgaattcccccaccaaggaagaggggctgcctggacttcattaatgcctggctctagagaaatgctttcagaactaacttgcgcagcagcgaccctctccccgggaggaaaagtaacccacaaacgggagaagcggtagcttcgtctctcctgagagctccttggagacagatttcagggcactgagggctgagctggaggaaaagcctccgcgggaggaggaggaaagtcagagctgtttcactcaggacgagccccaggttctcccaaggtggagctgatgaccaaaagacaaaagtgggg

SEQ ID NO: 1625 - DNA, 356 bp, Homo sapiens
gacagaggtgggaattttgatgtcctttctggagaagagaagagggctcgaggcagagcctggcaggatgggaacttgcgtaacagataggagagtttactcccaaaataagcgagtcatcttccatcctgttcaccatttattttgggggtctttccccaggcaccaaggcctgaatcctattatcagaactttcatgttctgttggatctcctcttgaactgcatttcccctaaaaggggcataagaagtcccatcttacagaaatggatacctcatggccttgggagtggctgatgtgtgcacaagctggacaggcgggagattggcacaagcacgcactgttgatattggaa

SEQ ID NO: 1626 - DNA, 69 bp, Homo sapiens
gtgattctagaaagtctaacttggaagagacccaagatatactttggttcaggaagtctcaccaggtga

SEQ ID NO: 1627 - DNA, 771 bp, Homo sapiens
gtaatttgttacagtggcaatggatagctaacacagctactgttggaagggttggctcctgctgtcaccaggatccaaagaattgagagaaatggatgacaggagcttatttccttcaaattatgtttgtttcttctgttgaacagtgtcctccagctgcggggtctctcctccctcagtaagtttttgactgttgtgtgggattcctctttggtagttggagcagccgctaatctcccttggtgctctagagagctgaccatcaccccctatttccctttacctttttcccaagaggcctcaggcacttcaagcagaccgaatttcctaggatttgtcttaatactccagagttctcctttaacacctaactttcccactctcttctatgtcacctcttccttctatcccctcaaaagtctgacaagcaaagccagaaactcaagcaagaatgggaatcaaatttctgtttcccatcaggagcaaggagggttgccctctgattcccaggattacaagagccactgaatcactcaacctttccctgtttctacagtttgagcaggctctaaaggctacattctacatgcagctccttcttgctgccaagaaagaagaccaggccctgacttcatctagagatcctcagggaacattctttcctaatcatcctgagaatctttctgatcatcacagcacccaccattcaccatgccaaatgagataacttagttattctctcttacaaaccctatgcttttgtgtaccctc

SEQ ID NO: 1628 - DNA, 63 bp, Homo sapiens
tatctcctatctgaggcaccaggcatataagtaaagaagaaaccatcttggacagtcaagcac

SEQ ID NO: 1629 - DNA, 375 bp, Homo sapiens
ttaggcaactaagatttgggggtagttttttacacaacaatagctaattgaaacattcccagacacaaccgccatcatgagactttaggtcttgtctttttgtttcaacaggctcttcccagcttcttggccagctctcccaatcccctccttgtcagttgcttgtagttctgtaactggcagcagtgctgggatcacctgcccaaccagttctttgtgtggccaggtgtaattaattaactagccatttctgggccccagactggagatgccattggtcttcaatctcctcctttgatgaggagcccttgagctggacccattaagggataggcaacgatgactagggcaattccagacacagaaccccacccc

SEQ ID NO: 1630 - DNA, 73 bp, Homo sapiens
tttgggaggatcaccatcttattgccgtcttagcaatattgaatcttctaatccagggatcaacaaactacag

SEQ ID NO: 1631 - DNA, 104 bp, Homo sapiens
cagaaagcggtgggggcaggggacattaatagattttttaaagtcaaattacatggtaaaaataccgaagtattattttaataatgctatggaaagacccacag

SEQ ID NO: 1632 - DNA, 1009 bp, Homo sapiens
tgatgttaaatggctcgtccatggtgatttttatttggtttccttttatcatctggaggcacaaataggattttcccacatctagctattgtagttccctatattcagatttaccattgaaattgccttctatctcttcacaccctgttagtgaacaggtagtattttgatggatgttacatgatcagagaaatcccgggtcttggcagcatgaggaacgtagctttctttaaatctttgtcttaattaatcattttttagtattttgaaagctttttggtgttgtagcaacctaatagaacattatttttacaaccttgtttgttcagaaatcattagccctttaagacatttatgttattgatgacatttattatttttttctttttccatcctttggcttccttttgaagtcacactattaaaccgccttaaaaatatttatgtgtgtttagttaacaaaagctcctgtaagttgaatccatgctgggaaaaggttcaggtaagctctctatataagcttacagacaattgtgtaaatcttcagccattaaagagaaaggagaaaaaagccaccctcattacactgctgtcatttactcttcatctcctgtcctctttagcagcattaagatgggatgtaaatttgccagttaatgctgttagaaaatggatggttcaagaagggcaggaattagagatcagtattaggtgcagataagctcctttgcctccgcagtggcggctgtttaacattcatgggaaaatcatcatcaaacagcgttatcacagctctgttgatggctgaggaacttcatcactatgataattttttttatagctgtgagccaaaaagctcccttttatttctgctgtctagagctgtgatagaggtttgtttgtatgggtaggagacagcaaaccctgggctcctcagccgggtttgatttcgcccccaccccccgtctctgttcttcccttgtgcatgttgcactaaacagtcctactg

SEQ ID NO: 1633 - DNA, 1359 bp, Homo sapiens
aagtcctccaacaatccttcaaagcataacagatatttttatgatcagtaattcaaagtttgacaagtgatgccattctgtaatgaaactgtcatccattttattgtgagcaaaatgctaacttgataaatggaaggtggaggggtgggagccagcccaaagcagggtaaataaatgcctgagtctgaatacctggaaagcaaactattcaaaacagtccaagtatccctcaatggcgtatttctcatcaataggctaagtcgtcaaagctccttgcctgtaattattcctttctgagtcaagcagagtaaaccggagcccggctcctctgtagtctctttttggttctattctatgtttatttttagagtgtttggggacaacattggttatgttattctaaaccaaccaaatttgctttagaacacacaatctttgcacatgatatttccctgacatgtttagacatcttcaagtatattagagataaaagtcacaggcgttgcttgcagcacatatggggcaaagacgtccggtattcttcgtagatagatatggaaacgattcaaagaaaatttacatttattaaggtgctcacgcttgtgcttctttgcagctttgacctcatttttggaggcttaactgctctaaatgactttttcccctttttggaatgcagctaaaaagcatagcactgaaaagcagttttgtagtctggacagaaaggtactatcatttaaatagttgggatttgaattcaggattgatttaactacttcagtaatttactttcaaccccagctcattccctttctttccccgagagcagacttccagtcctgccatgatgggctgaaatatgcttggagtttggagataaggacttttgtctatgaggctcagcttagacgaccaaactcatttcccagaagactagagtttgaatccagttaggatcctggaggtgaaaggctagcgccttatcatttaagtatagctatttaaacataagtttaaaagagatactgcaggatggagggacagcgtttctcctcgaaggataatcttggggacaagctggctggctgttccctaaagatcagatagccctctccatccccaaatagctttggccacctctgacttctcaagatcaaaagccaagaatgcttcctcattccaagattttctgttccatgcttgttttaaaaaaaaaaaaaatctaaggaggtgtttaatttttgttcacacactccatcataaactgacgatgggtttaagtcttaactccatgcctgaaaggaattcccagcatttcctctctcagctgaggaaactgcacggtgcttaccatcatcc

SEQ ID NO: 1634 - DNA, 3090 bp, Homo sapiens
tcttgtctgaagctgaagcctgggaaaacttcatggtattgtagcaagaggttccaggagctaaacctggctgatagccagagacatctcaagagcagcagggccattccacaacacgagaagtgagaagcaggaaagcccctttggcttcccaggtctgtgaaggaaggagggcagttggctcagttctgaagctgagtctaaaggaagcagattctgaggaaggtgtgtttcagatgtctattgcagtggcatggtgcggaaaaggaaactgaagtgggggactagtgggactcctttttaccaacaacgtcaaaaaataatgtttattgccattggccccctctagccctttctttctgtggaaatacacatcagggattcccctccttaatgataaagactgtgtaatgataagtcttgcatcataaagtggcctttttccagagtagatgaagaagaaaggggacccagggagcaagcgggagggagcggtggcattagagagcccaccagcatgtgccagccccagaaggagtcaaggccatcattgcatcagcccacagaggcttatgagcagcagtatgagccacacaaagtaggccaggctgcatttagccaccaccgaaatcacacattctctaatttagttcattttacactaacaactacaagaaacagctttgaggtcacaagaacaaaagacaacgatgataatttcctctggctcttttgccaagccatcagcaattttctagctttctttcccccacttaaatccacccatctatctcactatcttgaattcaccttattttttcttggaaataaaaaaattaatcaaccttttagtaactagaacccattatagagatatcttgtattcacagtatgtaggctatgactccgttattaattaatgcatcttttacctaattttgacttcggagctaagcatagttaatctcataaaaattgtattttaactttactagacatacctgtctagtaaaatccatgtacacccatgtatttgacagatttatagtacaggtcagttttgctgcaaacccaagtttatataaatctttgtattttcagattccctgtggatatcaggacttcctctggaaaatgtaaagataatcttacaacatctgagtttatgtcaattaacaaatgaggataacaagctggttgttttcattgatactatctgatatggcattggggattcttatctaaatctgtttatcaacactttcaatcaaatcaaaaggaagagatgctttgtaatgcagaaaccattcttttgtctcagggatatgaggaaacagttcattctgacagaagtggctattggtgaggaatgcttggtagcattttgggtggaagccagatttccagaatgttattctaagtggcctattttttcacctggttcccttactgtacattctttaggaagaacattggcactaagaaatcacaaatagtcatgcgtgggtcttcaatcataggatcttgaaccaaccttttgttttgttacccaatataatgggggggttctgcaattcccctgaacttacataagaactgagtatctgcccttccccatatacacataacagagatgctgctgaatacctcatcccagtcagtttccttcatggaatggatagacttgttctggtccatttatatcctcttgcccctctggacccagcgcacacctctgagtcagctgaccgacttctggaggcacgggagatcatggcatggtgataagccaattggcccatttagggtcaatctctgaatgttggagctaagtcgactagccacaaactccagggaacacacggctgcatctgaaagcatacaggttcatctgcattgcagcactgcccattgccacacctgctacccactgcagccagtgagaggtgctctttgaagttctgcccttcacacggtgcctcattagtcatagaccaaccaggccatgagaaaacatcagaatacatctgtcacctctaacaattcatggagcagattctccatttcctttgttatgctatgaataattctgcagcttctccgattttattaagaagcctttcccttggtttctctctgttcttctcatctaatctcttaatggaagttgctaattaaattcctatagccatttttttaacagtgttttgaatagcaaagtctgtcaactgcagaaagtgtatattcttatcaacacgcctgttgcctggaggagcgaaggcctcgctgacagatggctgccgaggaaggcccagcaggcctcgcatctgcagcacctggtggtgggggcacgggaacaagcgcagggctggagacgagggcctgtttgggctcaatcattagaatccaggttgctggagaggttctgtgaatctcaagtggaacttggcaaatttcagcaaagtattctgggcatgtagttgtttctaagcatctttggatgctgtcccattaacagtctcgtatccctttaaatctaagtgatagcaagtctctaaagggaaattttaaaagccaagtgcctgacatactgtataccaacacgtccttttatgggacatgagacatcaaattgagttccattaaatgtacttgttgctgtctggtaggaggtttcgaggccctcatgaataacaaggaatcatcctttagcctgaatttatatggaaattaagaatgcaaatatgttcctttaaagcaacttcgtttttacccccacataggtagtcagcaacacaatatcttgtagttgtgagtggttaattgaaggataatccagtaacacaagaatccgtactaaatcagtccctttaagggatcattggtccttgatcaaatgttggtacctgcctaaaacaaaaattcatttattctctcaacaaatactttcttcttgcctaatagttgtcgtataatgatgctgggtactagacatacagaggttgtgacaacctggctcaagagagcaggcagagcccacaggtctgctggctcctacatccacatttcacaaatcatcagaacagagat

SEQ ID NO: 1635 - DNA, 404 bp, Homo sapiens
cacgcgcatcctcataacagtgctggaaactacgagagactgaccagggctttaggaaatttctgaacaatagaagggatcaaatctatggaaaagtacgctaagagtccagcagaaagtaccgctcaagaaaaaagagggggaaacgcccctgagagagaagccatttggggttcagctccaaggtcagaggcaaaggatggagggaggcagggaggttccctgtggaaattgtctgagtggttaaaaattaactcagcaattatatctgtctgaaagaaatacttacatttgtgcagtctgtgtatgaaagacggtgagccttgctgcgtgactcgtaatatgaaaacaacctgatcgtccatctctcagtgagtgagttactatgaaattatgtagatcat

SEQ ID NO: 1636 - DNA, 33 bp, Homo sapiens
aagggaaagaaagagagagaaatgatgatagat

SEQ ID NO: 1637 - DNA, 218 bp, Homo sapiens
gtgtatgtacacatgtttgtgaatggaaaactacaggtctggaaggagacttaccaaatagttattaaagactttaccttttagacactgaatgagggtgtagtagggtggggcagacattcactttttattatcatgtttatgtaatgcctgaaatcgtatgaggccatattaacgtaatacatatgattacaggtatataaagtgcaaaaaaaaga

SEQ ID NO: 1638 - DNA, 838 bp, Homo sapiens
ctcagttcaaagtgcatatcaaagatgagcctggacagggatcaggaggaacctgagaggtcgtgaaggtccttgtaagctgtcttgagccatctcacctccctcctgagcctctcactggggcacatggtgtgtcggagccccagatgtgagggtgagaactataccggggaagcagcgtcttcatctccagtgagctcatctcactgtctcccttctccaacaagacaccgactgctcagagacacacagaattgcgtggaagtgactgagacagcctctctggaggttgggtcatcagttggaattcttctctccagttgggcctttgggccacccccatgacatcttcattctttctttcctgctggcccaagctgctctctgctggtggtcaagatgattcaggtaaggatgacagagcaggcacctctttcttcatcccttttctctgccttctgctaagatcagccaactactaataaactcctgcccagaaaattttacttcctgaaagctttcagaaaacttacaagtggaccagtcactccttcaagaagcatggacttgaggtcaagtgcacggactttccatgataccaagagggtttaggggtaggggagttacacagtcaaggcaggagaggagagctgctttttcctgaagtagcagctcatacattccccacagcactgccgctttccagaaggtttcatgcttggtctttcccgagtccaagctggcatcggagaagaacaggaatggctctcagtgcttggcatagccccgtgcaaactccagtgagtgtgtgcttgaaggacaggtgccacatcagcac

SEQ ID NO: 1639 - DNA, 193 bp, Homo sapiens
ggaggggcataattcaaccctccataggtgcctagtaatcttgttgctattcttgaggcctttgttctcattttcttcaccaggttcagagtcggttttagccctcacacttggtttaacatctatctaggatgctattttgcataaaaggagaacagcagataaaatgatgtggctttagagatgagattca

SEQ ID NO: 1640 - DNA, 721 bp, Homo sapiens
ggaggtacaaggttctaagtacttatgtttgacctcggtttcaggctgggtattaggcagacgacagttattttgaggagaaaatattaaaaataaatagtacgttcatcttgcaacttcttatcctatagcagggccttgaaaattccactcctgttgggcagaacagaactaggatcactcagattgttgaatactttcttggttatttctcacctcgtcccagtaaaggaatctgtctcttgattttcagaaagttttggtgtactaaactgtgctttgatccaattagagaaaaaactacgccaaatgctatgaaaacaaaacattttagttcatgaacttgaagaagtgttatcaaggcctttagctcagtctggtaaaccaaggagtaggatagcacacttcaaagactgggcagtatttttcttgggacctgaattaggaaagaatggggctggggaggagtggggtaggtgggggcgggtgtcctttggactcgcttacaaggcttggcttgataggagcactgggtgcctgtgaatatctgttatgtaatgcataccccaagcagttgtaaagtcattcagacaatggtcacacttgggaagtttccaactcatgaatactgcagatagcccattttcttcaccttcagttgaatctgatacttttgaatagactgtgaggtgttcgggactttatctgagccagagccgct

SEQ ID NO: 1641 - DNA, 1786 bp, Homo sapiens
cactagagtttttatctccaaagcaagaaaaatatggtaattttaaataaataagccaccacaacaaaatgtatttgggggaaaaaaaaactgtttccgaggagatttgtgcattttgaacatgggtaatgcctgtataaaagtctaaatgagtgactctaagctatagtctgtctttctctttgttctttaagaaaatattcacatctctccaactaaattaacatatattatcacaaatgtgtcattctcaaatttcctgagcttggcttatcactcaccgttcttttttttttttttttttgctcatgactgtctttctgaaaacaaaacaacattattcacaccaataagtgtaacaggcacaatgggagaaagtgctggaagcgacttctttgtacttatcggggtgacctctcactcttggcgtttcctttcttcgcctctctggagtcacgtctctgagaaggaactgtggaactctatgttccattaatgtccccacacccatttgtcctctacacgccctttgtgctctgggagaattcagcatccaggcaaaatctaactcctgactttattctgcagctgacaacagtgtatcttgtttaaagagaaatactcgattcctttcattgtcttaattcataggtggtttaaatggctagagaaaaagcctaagtctcctgagcttgaataaaaaataaaatgaaccatttacttaatgccccatttgaagccacgggccctttggagagtttggccagaccatttgtaagattggagatggtatttgcatacattcccacacctgggagtgaatctgtgtaatagacacttggatatataccagtgagaaatacaagttgggagtgtctaccagggaggagatctcagcccatactaaattctaattcaggtcaggaaaacagagttccctagcaagattccttttatatccaaatttaagattcagaaccaaaacagcagagaaagagaattcagaattttctgtctaatgccagtgggatactaagagtattactttcagattcaccatttaaagcaacttaccactaaaaatatcttctgatgaaatggaaactgaaccccctaccaggatattagaaattatgcagaaacaggttatagttttctgactttattaagatagatttctttgtgtgacctgagaggcaaataccattgacacaagttgctaaatgcttacggattaggataatgacacgaaatagcttgagctctgctatttttgcaatagacaaatttaggtataaagcatattacttatctttgcctgatgtttatatttctcataaacttttcagtcaatctaattttttaaatcaaaatataaccaaagccctagaggttgctcaggttaaaaatatattttaactatgactatcataggaacactagtgaccaaaaatgtattttaccaatgactcccagaaatctaagctttcagaattttcagaaccaccagaatagaaacagactttggtggaccccggatttttatttttgtttttgttttaacaaaccccacctctttctccagcatcttatcagtacatgcaggccatttatgatttttcctacatattcattcctttctcggagaaatttaagactttattaccaattttggtggatattctgtctaacttttatgttggacaggacttaagagaccctgagccaaatggggcccctgtttctgttgcttccagacagtgaaggacctgaaggctgaactggg

SEQ ID NO: 1642 - DNA, 1631 bp, Homo sapiens
tggggtgggggcagttgctctgtcttttccttaaattttcttataagtcacctctaatgagcagaagttgtatgcaaactccctaaagagagggcaggtaaattgtttcttaattctgctcagccaccacggatcaacatttattcctctggctcaaaaattacaaagttggttcatgcctggatgcttaagcctgtggggactcgagaactctaaaccgtactgggccttgacaggcagaatgtctgtaaaattactctgaaaacattaaatcttcatggctgggagattaagactctcttcctcagtgtaggtattttttagtacagagtgttaaaatcgacttgcctttgttaaagcttccatgttcctacggtttccacctaagccagtaaggagacatagggatgtattttttggtgctagaacactgtaaagaccgtgcccgtatcaggggcacacacagagcttttcttgaaatagacttttggtgtaagcctttttctgaaataaggctttggggaaaacaaaaagaaagaaaaaaagctacctgctctgattaggctcacaaagagactacagtactccacattatcttaagaaaaacaaaagcccgaaagcacagcccacagcctttccatcaagtagcaggcattaaagtacattagctctatcatttgtatgtctataaatatcaataaagtatgtgatttggcttcactttcacacaaagaaggaggactatccttttcaggaaatttcgcagagacactcaccaacaaaagttcagtaacttaatctttggaaagctcaataatgctgagttcaaaattgcaggttttaaactaatgtacctgataagtgctgatggcagaactaaagcgagccattattaggtaatccaatattcccaatcccggttatctgtaacagagaagagcctccctaaaacagcagtaatgtgttcacatctacattcatctctgaagtcaaaaagaggcattcttcatgggctttatctgtttccaaatgtctgcctccacaaggagtgatttcgcactgctgaggcaactatgcagatgactccaatatctttgtccaatgggtgctatttcttatggctctccgggactctgtcctacaggctggactttcacagctgtctggcttttatgttgaacagaacttagagaccctgagccaaatggggcctctgcttctgttgcttataaggggtgggggaagttggtcagggtttttttctcttctatgtgtcatactgcttccaacttttctccagcacaagttttcccttgcaaggtgtcatggtgcctatggagagggtttgtagagcatccctcatgcaaatttatttgcacagggccgcttatcactgctgttggtttgaaacatctatcttgtttctcctgagtggcagatcctacttccagagctgaaataaacatggtcctcaaactattcgttattcagtaacactttaagagataaggtgaaaaaaggtaaaacttattcaaggtgccgcatttgtcctgcctccctcctatggcaacatggacagcgactcttttattacatttgtgtgttgcacagttttacatgttctaacttgg

SEQ ID NO: 1643 - DNA, 633 bp, Homo sapiens
ccagaatctaagcctgaattaagataatcccaataagatccagagtgtaggatggcaggtggataacttagaatggggctaccacttcttttctccacagtctcgaagggttcttgcctggaaacacacattttcataaacaaatatattgacatatgtgaatttgcatgtttcatcttacgagtccaacagaattaagttaataagtacaatctttgggaaatgcatgcaagggcaggggcagtgacaggagcctgctgagtagaacattagtgttctttcactagcctcccaccctggactagttcacaggagacatcttaggacggaaaagaaggatcaaaacaaggactctccctcaaaaataggcactctgataattttgttatgagccacttatgatcctacaatctcttttcagaagttgtgtgtgtgaagcaggaattctctaagaatcagtaagtttttctattttataatgaccatctgaagaaggcacgtggctttctattaaaagtttggcaagctccagagtgaaaagaagtagacagcaatctcccatttactcagaatggtttaagaacattcaactatttcatactattaagagttatcatccatatcaaatacaga

SEQ ID NO: 1644 - DNA, 132 bp, Homo sapiens
cctaaagtcaggaacttgcaccgctgccgaggcaatgctgaggccatcggttaacatcctataatcctatagctatagaaaatgtatgagattgagctgagcacatgttgaatttattaggatacacctggg

SEQ ID NO: 1645 - DNA, 89 bp, Homo sapiens
aaaaaattcaattaaggtgttggagatgtagtagtgtggaggttatgagctcaaatggacaccataagtaacgtaagttacatctagag

SEQ ID NO: 1646 - DNA, 260 bp, Homo sapiens
ctctagagtcaaatgaaagtttgtttattcatttgattgcttatttcccattaacttgattaggtcaatgccaactcaaataagtctgtccataaaattcccttttctcccctcagaattataggttggccagactgattaaaaaaaaaaccaacaaatatttatttttcttttgtaccaccttgataaggagtcataaaattgtcaccctataaccacaaagagcatttaagcatttcaatatgtccatgcagcagtta

SEQ ID NO: 1647 - DNA, 434 bp, Homo sapiens
ttatctacttgtttcaaaagattcaatccagtaacattctaataactgtagagaactgtaataactcagataactatggattactcagagatgaataactcagagagttatagattacttagagaaagccatggagtgttctgtaaagatgcaactcctcaatatataatattacaacattccattaaatatcaattagttagaatacgggaattgacttaattttctgattagcagaagttttaagaaacttcttgcttcaaccttggctgaaattctttttaactcccctgccttgtgatataatacgcatatccaggtagtctttcattgctgaattagggtcactcattgcctcagagtcatcactgtagaccaaattgtcattataatcatagaaagtagtggaaagtatattgaataagttgtaattc

SEQ ID NO: 1648 - DNA, 432 bp, Homo sapiens
gtgtgtgtgtgtgtggtgctttcctcaccatggacaatctagagaacagaaaaattctagtaaataaatgatgtagctagttagggcttagcaaattgataatacagtgagatttcgtagggcactggaggactacaaaagatacaattcaactgggacatatgagtgttcaaacaacatgtggctctgctgattgggtgggaaatggtgttttggggacctcttcctccaaattcatcaactcagtatgtttcattgtctgataccttccgatgcacctctccactctacacttcaaattccatggatccctccatagttggcattatttggtcccattatgtacaatccaaatgtcaaggcaagaagccccagctcactccacatctgcactccagaggttcccaaatgaagaaggtttgcgttaaaaga

SEQ ID NO: 1649 - DNA, 1211 bp, Homo sapiens
caccctaaagaccagtcctcaattagaatactgaggggaccattttctccctgccagcccctctgatgttaatcatgtggaaatgaccaattctgggaatctgcccatttctctcctcctactaattattttgattaggccagcaaagcagagagatttcttcattccaacagagtcttatggaacagacagtttatgtcagataaaagcacacttatggtatggatttcagagcctgtcactcaggatgtatgtatatctttgacaacagattcctgaaggatttgcattttacaaagtacagtctaggcaagcctgaccttactggttccttgaatcccttgattaactgaaagtcaacaaaaatgccttaccaaaaacctagatgtgaagcatcttcataaaattcttcttatgctgataattatgaaaaaattatttatgagtggcacactgaaagtgactcaaggtccctgttctgattatgaattttcattgtaatttagtggcataagaagttgagctggctatgactaccttgaaaattcttccttcctgtgtctgggtatgtgtgttttaaaatgaaattctcaatatgggcttttgaaatgattttcatcctattcctttaagtataatacaaaaaagaatatggcatattttatgtttcaggtactgtgtagcatatcaaagcaggaaagagcctgctaccctcaggcttattccctatccatgtgggcggataacaccaatacccatgaaagaaggagaggaacgtactgctctggaacagaacagtgcatgctctgtatgatgcagagtacaaggtattcagagaatgggactctgtgaaggttggggtcctcaggaaaggcttcgcaaaggatatcaacctgaaccaacgtacatggccacatggtgctgctttcccctgcagacaacccagacttggaggttgagaagtggcagagcagttggacagaatccaactcatttatgatcatgaccaagagggtatttataaacagccaaataagacagaatagtaaggatgttaaaatatgccatgttctggttaattattatttccttgtaataataagatcagaaaggaattcagggactaaaatattgacataagtcataaataacctgaagtttgagttatttatttctatgctaccattgctgtaaggtaattaagaagtgct

SEQ ID NO: 1650 - DNA, 189 bp, Homo sapiens
ttaattaaattaaattaaaaaggtaagtgagaagtgctaaacgaacaaggagcctctcctattcctttggtagttcacttatgttatctattcggtttggtggcaggatctagattctctctatattaatagaacaccaactgaataacaaccatctaatgcaccaggcatgggactgtggcacctatt

SEQ ID NO: 1651 - DNA, 87 bp, Homo sapiens
tgtgcgtccctttacatagaaatgttgccatctgctgtgttagagacccacaacactggtagaaaatgacccaagtccagaactgcg

SEQ ID NO: 1652 - DNA, 50 bp, Homo sapiens
tgctacagggcatcctgggttctcgtccacttctgccagggctacgtaac

SEQ ID NO: 1653 - DNA, 2754 bp, Homo sapiens
tctctctttccttatttgtaaaatatctcggttgaactatatcctctgccttccccaaaccgctatagctccgtttctctgttgactgaacatggcacatccttcatcattattcatctttcatcacacatctatgcccatttcatgagtatgaagaagaaacagatcagcagaagcgacgtttccaattctccacttttgcacgcatcatacagtttggcaagattcacagaagtcccataaatgagagttctacaattaacctccaataccttgatgaagtatgtggaagtttgtcagagcacaaggccagatgccttacaattttccaaacattactaaaaaaacagcccacgctcactctgaattattgtggtctttcaaagtatatacaaagtaatacgcaaggagacaaagctattttaccaggcagacagatattccaaattactggttcttaacaagcatggtaatacatcagtcaaaagcaataaatttaaacttaatgaaatctcaatttgcctacagtgcatttcactttgacatgttctatattgccacggtgctttgataaagttttttaaaatgcaaagaaagtgtctgtaaggctaaagaccagacttggtaccattgtggccaaggcaacattacagtacttaaatttcatcactctatgccccgtggcaggcagagccccggcgctaacacaggttcagttttcattatcatcatatgattacgcattttactgcatttaactgataatacaactaccagctcaccttaaaagaattagcttggaggtttcattgctttccaaatggaattcatttgacaaacaaatgacaattagcctagtctccctgttctgcgtcaggatgctttttgattgaacctagaccaatttacaatttttaaatgagtttagacatttacatttaaaatgtctacaggaaattagccctgggacatccaacagccaaaatgctttttgaagttgattattatttgatctagtaccctctacctgtacattttgttctgacttcaaagttcgggaatgtaaatgccacctcacctcaaagcacagggagaaacttaaaagcggttttgctcattatgttatgcaaaggagcccatattttaatattcgtttaatatggttagttagctttaatgacaccagtgtgacagtgtcatagttttggaatctgaaagcgctgattgaagtttccggccgctgcctctatttttctgcacagaaaggaatcttgccctttgaaagacagatcagctcctggctgcgtccattctggcgagggctaaacgtaataactttgagatgaagagttcacctgcctcagtgaagaaagcacaaatcatgatatcaggggctacagagacacttgactgtcagattccaattctgtgtgttttctaagtgcaagccctttgcccaccgctgctgaggaagctgctagtaattccattataaacatgcagtgctgataacccagccacagaaactggtattgccctgaaattaagcccactgatttctagccgagagcatattttatttatttattattgtttttgtagctacattattgtcaaaatgagaaaacaacagcctttttctcattccgtgttgtacaactgcaaaaattaaatatggtgaggggaaagcttgcaaaatgttctattgcacccatcaccctgttctgaaggcctggtaatcagtgttatccacaatatattcaaaggaacgctctggaagaaagggcatgtgacacagggctgaggagtcggcgagtccctatctgcatggagttatcatggctttcacaggtcatccctgagagctcaccagaatattttgaatttctagttttgtctcacactataggacacacaccacatgttttcaaaataactttgagttcaaaagagttccctaagataacactgtataaccccagcacagaattaatggttttgaagactgttttctgtgaaggtagcagaggctgacttcagtaatcctggccctccggagtgctcacaacagtatcatgaggcaagaatgcctggagagggagacgtcacagatctaagaatggcagcggagggcgccatgtttggtctccttgggagaattggtctgaatcccctgatctcaccaccacttattgtgaaaatagtgataaaataaaaaaattaaaaaaagtcttttcatccattttattgctgaagagattagacgtcctctaaactgtgtgatttcgcatcagcatcctttcaccctgctgcactccaacctcattttccttaatgaaaatggaatccaggtctccgccaaagtgtccttggagtcaactctgttttgattctaaatgtaacacacaagcaccacattttctcacgcacacattgtcccgagtagagacacgccaattctttctatcaagggcttctcattgtctatttttattccagtagaaacagtaccctttcttcctgtgctaacaccctggcggcaaccatcttgcacagcatcctcagccggtggctttgaagtctccagagttgcctaagagcccgggctgcacagctggaaacctggaggtttttgctacctcgtccgccctctgctggatggaccgacgtctgcttacgaagtggcccacaaacagccgaaaggtttccccttaagatggatgggtttgtcactaagccacgggaaatcatttt

SEQ ID NO: 1654 - DNA, 261 bp, Homo sapiens
cagagatttttagaaatacactttcttctctccagatatacaggtgtaccagtttattctgcctatgtgtttggaaaaaaacagagaatttgtcagtgaaaaccatgaaggattctaacatctctctctgacaatcaaatgctatatgtgcccctgccctggcactaatgacctggcaacaaggaaataaaataatgctaaatcagaataattattctaatattctcacaacacgaagaagcagaatatgatgagggttaa

SEQ ID NO: 1655 - DNA, 63 bp, Homo sapiens
gggttaactatatataaaactgtatacatagttaacaaagataagtgtatttatatatagtta

SEQ ID NO: 1656 - DNA, 246 bp, Homo sapiens
tggattgttatgattagccctatatatagttatacatatactctatatatattataatactatttgtctcccaaggttgttatagttaacccatataagaccaatagtattataaattctgattcttgagaaaaggggctagctttgcaggaattattgatatcttccttgttggccttcataaaagaaggctaatagttaaaatagtttttatgtagtagacacacattaacatggagactactt

SEQ ID NO: 1657 - DNA, 834 bp, Homo sapiens
aaggtgaagaatggtctaaaatgaccatataaaatgcaaaacctcacctggaattcccacttcctaattttacaaaagattcctttgtatggagagatctctgtgctggaaaatgtcacaatctaaaagaatgacagaagagatataaagtcctcattatccagggtccagagactttgtatttaggaaaatccacaaatagaaaggatataattgcccacaaaaaataacataggagttgcagtgccaattcagtaatacacagagcaaaacatcacatccttatgctcaaagtttcatctttatgaaatagaaaatgcattttctatttcatacagtgctcgataaaactccacgccacagcggtgcagaatattcttgaagggttctcagaattaaagtgggttcgtaggtactaactcaaacactcttaagggttgctgaagagcaactcgggatattgcagatatgccagaagatattttttctctgttaaaaagtggagcatctgtaggtataagatacagatatacacagtgtatactgtatataatgaatcttctctcttatccaatttcccaaatagctgaagtgatataagagggaaataactacatcttgttcatcaggccacgataaatcatatctctatgaaacttcaagttaaattattattggaatctactgtatactggattccatctttctttaatgaatttccatggaggaaaacaacctgaggttaattcacaggtcacagaacaagcccatgatgatggcctgttcttcatcactgtgtgtgaaactatttttagtaacctaccttctactcct

SEQ ID NO: 1658 - DNA, 180 bp, Homo sapiens
taaactcttgttgctttttctcactcccttaatcttttttctcagtaactaatcatgctcaagtcaaagttataaacatacagtcaagtagagatgagacatatgagaatattattgctcaaatatttaaattgtcagattaaatgatccagatgaatatatttatttgtatacaaaagt

SEQ ID NO: 1659 - DNA, 1626 bp, Homo sapiens
cccacagaaagcaaactacccatgtaccaactggacccacaatgattggctcaagattattatcttcgttataaacgtggtaaaatgagcaaactccacttaagaaacaagctgctgttcttcacatttataagtcacagtctgagggatcttagagtctaagatctcataattaaggggtgctgatccccaaggtaacttgacatttgcagaaaaatattgaatcttttttgcaatgtattaaattttgattacattgactagtctctaatgattccttgtagttagatagtttgctggttggtacccttccctggaaaccagtaggtttcttcatccacatgcataaattacatttggtgatgttgtagcagagattagtagagctttggtttggtaaaactaattcttaagcatagataaagagccattccattcacttgggaaagatctgcaatgaaagtcaccattcatgggtccagagccatctcctctcagtgtggccacgggttcccattctcaaggcggagtgaaagtgagaccgaggaactctcacttgacaaacgctttttcatgtgaaataacatgaactccttttccccctagactaagttgtgtcagatcattgtctcttccgcagtacaggaagagaagctaatctataaaacaatgagacttcactctggatgccaaaatctgcaattacattgtacggaggggcttcatgaataattcctggggtatgatctgacattaatctggaagttaatacagagctggggcattgccagcataaagctgactgatttctttataacagagcactttcaaggtgaggatacagccttttctctaagttacactctccatccaagctgagcactaagctatcatctttacgtcttctgtttcctcctctgagttggatgtctgggtattggcaacacagtaccatcttagaaaaaaaaggcacttcaattaggcaagacagctccaagattttagctatttctcacatattagttagttttaaatggccttgtaagaaaataccctagtgtggtataactgtacatgtgacactgttcctggccaagcctttgaccaaggtcccagtttgctctcagaactggtcccttactaaggcctagggaaaataatctcagaaaatctcctttaggagttattgatggatcaatgttggtatcacctcttgaagtaaatcagaattatgatgaatcttttctgatgatcttttcttagttaacatgtttcttgattcaaatgcatgtttatagggtacatatgttcagcattgtaacagaaattttgataaattattaaaagaaaaaaaaaacctaaccaatcaacaacaacatgttttctgccccgggggatcttcctatccagctaaagaaaaatgagtagaacagataataatgtttagagaaagaagtggtgagtggaatggaatgctgggagaaagcattttgccgaggagggatgagtttgggttgagctttggtggctggtaagagtttgggttgatgaagagaagttttgtgatttttttaagataataataaccaagcaaaagagtgggcatgacactgattttcctgtgta

SEQ ID NO: 1660 - DNA, 43 bp, Homo sapiens
tggctcgggactgttcagcattttcttgttctgtttgttggca

SEQ ID NO: 1661 - DNA, 316 bp, Homo sapiens
atgtacctgcagcacacgaagaactgcccgagtatgactgtttctccgtatttgttcagcggctgaatgtttacaaaactgtacacaaaaatctcagattggcctgacgagaacagaaaactgatatcagggggttgaaaatgaaaagtagagagataggatgggcaaaacaatggccatctttaaatgtcgagattgtaaatttgaacaattttctgtgaatagtgaagaatcaatggagatatacaaaaatacaggaacagcaatcagatcgtcagcctcatacctaaaatcattgctgtgtccctaaccctga

SEQ ID NO: 1662 - DNA, 199 bp, Homo sapiens
gattgaaatggttttcctagaaaaattacataacatttcaaaattacccataatttcagcatgataccactcttataatttcttcatactttctttcatgctgttactcacattttatatagttgtactacaactattatacaattttgtgatatgctcttttttacataatgttatcatgtaaaaattctcttttcac

SEQ ID NO: 1663 - DNA, 40 bp, Homo sapiens
gtaatggttgttgtttagttccttttctctagttaaaatt

SEQ ID NO: 1664 - DNA, 103 bp, Homo sapiens
tactatttgccaattttactaaaaatctcatgatcatcaactattacctaacaaaaataaatgctaataaaacttttacctaataaaaatgaatgctactttt

SEQ ID NO: 1665 - DNA, 319 bp, Homo sapiens
atagcactacataaatagcactacaaaaagtactacagtttgtctttttttatataaatatattacctaacttgaatttatttttactttttatatttttactgcagaggcattttaaaatttgtttgcaatttattactttgcaattccttcagttgcttcaatctttggaaagttctcatccttccgtctacctgatattctattttatttttggctgattttcattgatttgatcttttccagcttaaatttttttccatatggagattggttttggtacatagaaaacaaggaataaaggaattttcctcactcc

SEQ ID NO: 1666 - DNA, 67 bp, Homo sapiens
ctaaaactctatattttgctagaaaattatagaaattataatgtgtatgttctagcaatagtataaa

SEQ ID NO: 1667 - DNA, 169 bp, Homo sapiens
tcatggttgtggcctttgggacctacatcacttatttatctctatattagagccaattcaaaattattccttgggaattttatcacttcaggtaagattcaagtgcaagtaatagaaactcatgaagccatggctaaaacaagtgagtctcacagattcacagtcattg

SEQ ID NO: 1668 - DNA, 126 bp, Homo sapiens
tgcatactccaaaatggctgttggagtaccagccatcatcttctcattccatcttctcattctcgttccaagcagcaggttaaagaatgagaaaagaaaggtacacttcccccattttaaagagac

SEQ ID NO: 1669 - DNA, 178 bp, Homo sapiens
tttttcttttttcaatttgagagaggagggtgaaaataactctttggtaggtaactgtctgggccacagaatcttgacactgaccaaatataattctttgacctgaggcaagtcaaaatggccttctattcaaacacatatactttcaaagcttatcagtctttacgtcagtcttcct

SEQ ID NO: 1670 - DNA, 660 bp, Homo sapiens
cagcatttttcccaggagagctgattgttaagagtatttaaccaataccatacactatatgaccctgggtactttttagagcttataattttaaactcactcctgcacaatgtctgtcaatgttgttatttgtatcttaaattggttctcttgaacaaattgaaaaatatcctattccaattaagttttgtaagttagaaatgaaaaacttttgtcaaatttttcttttgctatatttaagatgaattattcatttttaaaaatttgacctacaactgtgaattatttcatcaagttttttttagtaattatagtcagttcttagtttgaactttccttgcattccaggagtaaatttattgaacaattatttgtttaaagtattactgaattattcttactacattttatttgaaaatttcacatatatattcataagtctttccacccatgttttctgttatcttcatcttgttttggatgagaactaaatcatgattagattaagctgtattttcatggagactaaattaggtaatttaccatatttttctatgttcaaaatagttttatataatagtaattttctattccttatattaatctattggttctctttgccttttgatattcataggaaagcagtaatattattaagag

SEQ ID NO: 1671 - DNA, 56 bp, Homo sapiens
aaattaaaaaaaaaagagtttttcaattctttctttgtgtattgatctatgcaaga

SEQ ID NO: 1672 - DNA, 708 bp, Homo sapiens
tattatgccactttgtctttcttaaaattggggcatctaatttaaaagtctaaattcagttattagaatgtatacatgtttatatctatatgggtttttaaattaccattattttcttgtctgctcttaaaccacttgtgggtatatttaatgtatatataaatcctgagatatttagtgaagttttaacaaattatagtttggtgatttaaagcttattgagatctttctttgtggaagtattttgtattcagtttctaaatattctgaggatacacaaacaaggactgttccatggttataaaacaaaaatctaacacatatttattaattcctccattatttatctttttaacctcctcgaagtctttttgtctacttatttggtattaattttaggttttgtttttaagtattttatgcctttgttaattgtcttttgtctttggcttatccttgtcttccttcatactttgttacatgaaagtccatgttactgttattaattacctgggtcctgctttctttttgttccattgcaatacctcttttcctgtgcttttgttttactatatttgtgtatatctatgctccttttaaggtgtctcttctcttgaattacataattgattttgatagtttgcctcttaatgcaagcaagtttgagcgtttatgtttatttttaattaattagctaattaattaaac

SEQ ID NO: 1673 - DNA, 51 bp, Homo sapiens
ggtcattattgcagtggaataattactactatgtgatttgtcttttgttat

SEQ ID NO: 1674 - DNA, 74 bp, Homo sapiens
gttatcatgtcgtgtatttttcatgaaatacacaagtaaaaaggtcatcagatttaaaatcaacaatgtaattc

SEQ ID NO: 1675 - DNA, 580 bp, Homo sapiens
acaacaaaacaagcccctacctctagcttgtgtatatctgatatacattagggttactctgattggagatttcattttccctttttggcctataggttaagtcacatctctgtggataggtacagttattaccgaaaacacttgataatcattcttaatgctatatttgactatatttattgttaatatttttggactgatttttatggcagacaaagactgttggcattttgaaattccctccttttccttcattcattcactttttcatttatttaacctaaaatcctgaaatatctctattttgcttcttcagttttcttgacttaaagagtttttttttagttcagtggtagcttcaactagttaaacttatcagtaacaacgcttttcttaatatgtgttgcttatttacttttcaccatctattaacctatgcttgttacatccaccaacatcctttaagaaaaagggtttgtgaattttacatgttctaagacagctattctgagaatgccttttagtttactctatatactgaccctagtcaactgcatatacttctatgacatcatcattc

SEQ ID NO: 1676 - DNA, 44 bp, Homo sapiens
gcccaaaatttcccccaaactgctgcttcttctgaattccccag

SEQ ID NO: 1677 - DNA, 538 bp, Homo sapiens
taacatcacactcaaaaccctccatgtttcctgagcgctctaagttaaatgaatatatgaacttctgactcagttgtctttatgaatgaaacacattctttagccacattctttctccttgaaatgcgattccaccatgtctaattttgatcatttaaatgggaaaggataaaaaccctctccagtttattctcctttctaagtaacctcaattttttacttgtaaacaaggaatatcccttttcttttcatgaagctatatttcagtgttagtccctgtctatagcacatcaactctatagccttctcaatttatagtctcatgtgcacacatattcctctcttcaggaactcctatcacccacctaggatccgttctctaccctccagttctatatactttttgctatatattcagcttatatgacttcattttatcttctctactgatctaattttcatattttaattctaatttttattacttccaatggtaagctaatgctgttttctttttttgattcagttttctgccttt

SEQ ID NO: 1678 - DNA, 158 bp, Homo sapiens
tcccatatcaggataaataagatgaagatgtttagtaaccatgcatctttggttatatctttgaatataaattccagccattctcagaaatattttgtttttttgtaaacatgcatttcaggtgtagtcttacaagttctttttttttcttcttaagt

SEQ ID NO: 1679 - DNA, 1342 bp, Homo sapiens
tcaaacctttttttcagagctacttttatttctgattattcatgcattcttaaatttcaccttccaatctttgctgaaatttctgaaagtggcctatgtttcaggtaacattgacgatttttttaatagaattttaaaggaggggtttgctactgttcttgtgtggttgtcattctaaatgtctccctctaaaggagatacttttaaaggactcgtttggaggatggataagaaggcaacagaacagttaggaggtttgcaataaacagtgtctgtagcaatacaagcttagattacaataacaatgggaaacaaacaaacatgaaaaggctgaccatgagatatattctaactgacttcatccaaatctggtgttctgcagcatgaactagatcaatgaatcattctgtcatttaacccatttgacatgggacaaatttaaaatgctaacagctatcaattttcttgggcagtaatgacaatcagtattgtttttgagcactcttgaagtaagtaaagcacaattccccccaaaaaatctataagagctgccttttcatcagctttctgtgtgcaagcacccgtcatctaagccacacaactcaacaggacaatctgattagggccttgagctgcaggaggggaggcagccacactttgcagccctgcctggtctactgtcagcccactgttagccccttatccctacatgactgttaaaagtaaactacagtaatagagttaattcttcttttcacattgccccaatattaccagcatcattattggagtagttgggtctcttgagatatgttctggaaagatcttgcaaataggagttaaatgcctgcctgcattgaagagtaacaaaaatgtaaatttcagtcatcttactcgtaaagtagacgtatttcaccaaggccagatgaatctaacagctgcatttccattcttgtgtgttgctaagtaaaaacagacctacagaatagtcaaacaggcagaagtgcttctctaaatacatacagtgtgcagagaccctggccagtggaaaggatcccaacagggacccctaaagagatgtgatgacacattgcaggagagaagaaggctttccacattggaagtacttaaataaatactgtgtagcttaggaatgcttaaaagcaacactttaggtctgtttcgaggtaactagcaggaaatggcccagagatattctgctttagatggagttggaaattatgtgtattcaattcttgcttgactctaccgagtgaccataaatttcaaagctgtgacctctaattgttgctcagaaacgtacttgtgccatagcccttaa

SEQ ID NO: 1680 - DNA, 100 bp, Homo sapiens
aatagattttaaattttacagttcaaataagcatgttacaaaacatatcagaaaggaaaattcaaggccaggcgtagtggctcacgcctgtaatctcagc

SEQ ID NO: 1681 - DNA, 120 bp, Homo sapiens
ttctatccgaaatccaaattatgaactattacagtcacatgctaacattaataccttgaatcaattctcttctattgattttcttttttctgggtatggtggtgcatgcctgtagtgcag

SEQ ID NO: 1682 - DNA, 75 bp, Homo sapiens
tctattggttttctattgaacaatattaccttcataggaaatgaatagaatagtgtctctctctctctctctgtg

SEQ ID NO: 1683 - DNA, 536 bp, Homo sapiens
agtatatttttaaaacagagggggaaaacaccaaagtggcccaggttggagtgaaagcttttttcactgagatggcctcacagaccagcacacaacatggagtcccagaggtcttcagaccctggctgaaagctgctttctctatgccaatcaaatctgtaaagtacaagatgtcctgtacccaagtggagatgcttttgtgtctttgctgctttcttccaaaatactggctcttcctcctttttgtctactttatttctcaaaataagttgtagatcattcttggaggctcaacgcagcccaaaacaatcttactctgcaatgcccacccaggcccttagcacagcagctggctatttgatatccaatttagggcatttctgtcttctttccccgcccagtctcatccataagagcaaggtctgtgttagcccctgggcagcccagaagaccacttttttgtactgatagtagataatacatatataactggcttgagggaggaaaaaaattaagcattgttttgggccagtgca

SEQ ID NO: 1684 - DNA, 314 bp, Homo sapiens
ccaaatcaaaaagcattgtttggatatctaagccactgtttccttcgagtattaataatctagttttatgtacctccaaaactgactctcactgacctagataaatggttattataagccttaagactcatcaggcaaaagccttttttaaccaccactacctccaaggaaaaaaactgtttatcaaaatacacacctttaaaatttttctaatacttagtatcattatggtactgttgtgatattactaatacaaaaatataaacagtggtagagtcatcccactgtacctacgggggattggttccagggcc

SEQ ID NO: 1685 - DNA, 376 bp, Homo sapiens
tacttatttcttatgaaaagaggtcaatttgattaagtttctctgttcctaaaaaatttggaatctggggccccagatgcctggggaagaaagtatgaccgaaagcaagaagctttaacaacagcttacttgatgtctcagctggagaagggagttcccagggtctcattaatactcagcaagtctaacagtgagctactttggtgaaggcaaacaaggaagactgcttaaacacacaacaaagcaactaaaccttctacggtactatactgccaaaagggcagcttcttctccttacagctcttccatctgacactggtacggcactgagactcgtcacaccattatgtacccaatctccacattgtagagcatg

SEQ ID NO: 1686 - DNA, 845 bp, Homo sapiens
tgtacgtgtgtgtatatgtgtttgaaaataatgtttacatgtatggtatgctcttaaataaggaccgggaggatagcaaaaataatacacacacatatgcatatatatgctgagtataataaatagatggcaaaaataaagaaaagtattttaccacttcactttcaccatcatagtgtcatattgattttttacaatatgatctgaagataatttgaagaaattatgtaaaatatgagataccacattaataaatttccctccaaggcaagattacatgtagaccatttaatattccttctgaccagatccaagctttacttataaacagtttataagattctgaagaaaatatgattgcaatacagtaagatctctaactgcattctggcagcacatcaaaacacatgtcccaagaggcctaatattgcatggtcagcgaagaggaaaagtcaaagaagtcttctactttgctgtttctctgaagagggaatcacattaggccattaagtagtcagatacattattttattgcttgcaaaacccttgggtaataaagaatgagtacaaattgccacaggcagttttggaagaaaaacagaactgtgcaaaacaatgacagttgctctactgcagcactggacaaatgcagtaaagaaaacagtacatcagttgcagtttttctgcttaagtagagtgctctgccttgtgtgagaaggagctatacaagcacataactgcagaatctgtgtgtgaatgcacaagtaggacaaaggtgatagactgtaaatgcgtttgtaaaagctatcaagtcggattcagtctgtctttgactctctctctct

SEQ ID NO: 1687 - DNA, 1178 bp, Homo sapiens
gagttccatttccttctaaataataagactgaggagcagctacagtgaaaagcatgcgcactctggacacacaaaagtaaaaaaggtaaagagttttcattgagaggaacattaatatttttcaatgaggatgctaagacaaaaataaagagtgatacttctttaatgtggcctatgagagaagaaaacgacttactttctatgcaaagaaaactcatttgtatcacaccttgtacaggtaaacagcaagaatgagggatttattttcatgggattaagagaatgaaactggactcacatctttagccttgcttgaaaaatgctgttaaatatcgtatgttcttctaaagactactcaaacttcattattgtgctactttaaggtattgtgtgagcattttatctactttcaatgtcaaaaaccgcaattacttttgcaccaatctaatatatacttctatactgttaaattttccaaagtatgagaatcctgtaacactatgattataaacaatgtaagaactttacatttaattacagaatctcataagagtttttatctgtaacaaaatacagaggacccctaacttgtgaattttcaactttcaaaattgtattaaaaaaaaaaaaaactctagagcaaaagcgcatcaactctaccggctaccaacagagggcgaaagcggtcacatgcagccactccaacacttcctgctacttcatcttctacagttggacaggttcatgcttagtttcatgaagttttaaataactgactctattaagtttaacaaacaaaagcattacaaataagaaatgtacaaccaaccacaacaaagtaagagattttaacaactgaaggtgatgagaaaatgatgaatgtttctgcgagtggaaataattgtggaggacaaagtgaaccctgcaatactggaaatatactgacacacaatcaaaaataatcaacaagagatgaaaaaaagctataagatagagaattataaacagagaatatgaaatatgtaaaaactatttttattatacactcctattaaaaaatacatccataatatttgtatatttatttttctaattttctatgtgtacctctgtatttcattcaatctaagaaatacatcaactgtagacatattagaaccaatgaagtatggtatttg

SEQ ID NO: 1688 - DNA, 323 bp, Homo sapiens
acagtttggagatcccccatcagaatataggatgaaataaataaaatggtagatgttagatctcaataaatgctactgaaaagtagatgcctcatctcccctattacatttattatatattggatatcatcatctgtgataaacctgacaaaacaagcaaaaaagcatgaaacaaatatttcttataaagcatccccccaaagttattcattagagtaatgatgctgtaggagtgaaaggcacagattttagagtcagaccaacttggatttgtggcatggctatctatgccagtcactactaaaagcaccagacacttgcgt

SEQ ID NO: 1689 - DNA, 1803 bp, Homo sapiens
aaagagattattcatggcaacttatttcatctgtttaattacactagcttatccaaagtgttggacagaaagatgatatgtgaaagggtttgacttaaccagtctacttcacttaagtcacttttagataccacaattgctgacacaaatacagtatgaaccctcagaccaaagcccatttctgcttatagatgtgagtaaatacaggaaacgcaccaacaatgagcaagcatactggcctctttatctaacataagcttcagggtacaggggttcttcgtgaatctagcactggaaagttctatgtgcctgccgtaatcagcctcagatgcatctgacagctgataatactaatgggacaacaaagcacactgtgaacaacacaggccagaagaatctccacaacagcaaggctcatttcaacaggacagttttcttaataagagcttttaaaacaaatgccaattaaatacgaatttattgataatatgatctgtagagctatattttgctaattatcatttatcaaacactaccacttcttaaatacaaacactcctgatacactgtttaggatttccaaaatgatcaactaaaggattattgggcacaaactgaagtatggatggcaaaatcttgacacagattgtgggaaacaggatggtagaataactggcctatacatgtgttttctgacctctgctgcctctgtttattgccctaggattggcaacagctattctcagaataagaaatctgaattccatctactaacttgaattgactttctacatgtgcttttcagaatgtcagtgttttaaatttgaacttttaatttatattttaaggactccaatctgtactctccctgaaattgttaagattctaacctgtaataatacctgtctgttcttgttgtgtacaaccatacactaccactggcatcacccttaacatttaatgcggggggtgggggggcgtgcatgtccctcatttaaggttcaaaacttgagaactctggttataacctgggcaatgaactggatccaagagtcagcgtagtcaagagaatgcagcactaacgtcattaccgagtgccatgagaatgataaaggcagtgcctcccttgaagtgtctgagaaaactcatgccccaaggaacgcagagcctctatctcattcaatgtggacatcttctcccccacaacagaccataaaagcagtctatacgccagaaacaggaatagaaatggaagataatgccaaaagaatcctgagcagccctattaaagatgatacgtggaaccaagacttgttggcggctgaactcacttcccattaagaacaattctaacttttgtccatttccctagtagatgctatctagccaactcccttcacatatcactgtttaggaagatgagatttactgacatgtattaacaatgggtaggtaagtatgtgggtacctttaagtatcaccaacccttggttttctcattttatttatttttgcttcattaataaagctaatttgtacttcccatttgctttcctttgcatttcttttaagtattaggcagatgaatgcttttcttataaagtttcttgtaaagactggttgaaactgagtattctttggtactgactttttagctatcaattacttgcacagattaaggtctaatgaatgtgttcatttgtagtattttgtgaatatagtatttgatatatttaccatgaccagtccattgcttttctctttaatacacgtagtgcactccaaatccaaaacagtccaaaa

SEQ ID NO: 1690 - DNA, 161 bp, Homo sapiens
aaaccaccaaaatgcagttataattacattcaagttttacaaagtgtaaatatctctcactcttggcatgattcattaagggctaaaatagataaagtagctgccaggggtcatgtccaagggcaggagctattataagacaggcaactaactgtaatccc

SEQ ID NO: 1691 - DNA, 807 bp, Homo sapiens
gttcaggctctttagcaccacactaaggatctaaaacactcgcctagcacctaacatagtgatgaaaattatgataaaccacacagtgcccagaataatatacaagcatgccgcaccctagaggcccttaaagatggtcttgattgagacagcatataaagtacacaagtacatctacattacatttacatagcacagaaatctttaaagatacaaattaatgctaccactttaggaatttagaagaaatcatcaacatactatttcaaaaatggctgtttcccagcatgagtgcctagattttctcttaacattgttaagtgaatcttacaaataattggcagctaatattttggtcctatcaatatttagcactcaatttcaattataaactaatgatattaatttttgaaagaaaatattcaagtgtactttaatacaaagattcagaagataataaaatttactattattttcaaaatatcagtatttttaatgaataacgtaataaatgttcattgaagaaaactgaaaaataccaggatatagagaagacaacagttcattactttaatgaataaagtaataaatgttcattgaagaaaactgaaaaataccaggatatagagaagacagcagttcaatatcggctttacatttcaatgtagtttgagacattaaattttaagataaatgacttctttatctcaattttggaaactgatgaaatttcatgaactgaaataatcactgtcaaggtgtttcaagaaagaaatgtgcttcaaacaggtgaaacattaattccac

SEQ ID NO: 1692 - DNA, 704 bp, Homo sapiens
gactataggcatgtgccaccattctgcagatactcttgttaaagaccctttatgcactatgttcaactacagtgctaaacctcaaacaatattttcatcatatgatgtgattagtgattaaacaaaacaagcattacttaagaggaattttataaaaccttggagttcccagaaacattacatatgtatatgcaccgtaactgattagcatactacattacacccagtctgggccagtaaacattattttatatgggcatgctctatctccttcaaactactattacaacattaaacaccactacttaaattccctttctgctccatatccctatttccagccatactaccctggtataagtaagtactatgggcttataaattagctcactgaaggatacagaagttgtcatctgatttgaaatgcatgggattagatttttattcacattggatgttgcctaaacaatcctggctctattttgcaacttcccgcatttgtaaaacttccttttaactgcaacaagcaactggagaaaaggattaataggaaacctggcactacagttcaccaaataacacagtacacaagtagacacaggtctgtagggaaatacagtcaggaccagccactgaacacaattgctttttgagtccaaagataaaacagcttgaatctcagattgtcataagcatttactgtg

SEQ ID NO: 1693 - DNA, 131 bp, Homo sapiens
tggtaaagaattagactaatttcaatccaaatattcacgtgcctgctatgtgctgtgtattagttcacaaactgaattttctaaagagacttctttagtaaacacatgaaacatgcctgtttacaatacag

SEQ ID NO: 1694 - DNA, 501 bp, Homo sapiens
tgttaagccaccgtgccaggcccacagttcacttttgtgaagtcaataaaattaactgagaggcagtacagattcatgggaagaacagaaatccaagcactggaatcacttagtgaattaaatactgtagtgctttatgcaaatcattcaacctcttacttattacagatgggcaatcttacctcacaagtccttctaactccagtaacaaaacaaattaggttcgtttgttaaaaaatagcattgattcatttgaaagtccacactcggatactaggaatttgaattaaaactttaagtatttaattctgcttaatactatggtagattataagtaaaattacttgtatgtggataaaatgtgagaatattctgaaagaatatattagagaccattcattgtgaatatgtctggtgaaaaggggaaacagaaggtaaagaatgtgacttctgtttctcaacgtgcagtctcttacactgcctaattcttccatgggtatg

SEQ ID NO: 1695 - DNA, 760 bp, Homo sapiens
caacatgctagctctcttatgaaaacaagaatgaaactacactgttgccaccatcccaatggactcaatgttatattactggtcttaggttactattctctcattcaatcgttcagtgcattcatcaaacactgaaagaagaacaagaactaaatgaatgtaaaagagtgtagaaattaatttctctgtaatcaaaataattgatagtaaaaaaatactgtcagagttctggaaatgcttaatttgctaaagaaaaggagagaacagataaaagataaacttggtgaaaacccaaaatctattattgaggaaggtaaataagtacatgttcaacccttgacctgagctgattttattagaatgctttccaaacatatgtcagtaactaaatttttgaaatcttctaaaacacataaattacacctctagtaggagggatgatattatcttccgtttcctaaatgagtgatggatcataccttctttctctaaatacaaattcaattactgatctccctaatgatggatctgaatgcatgaaattaactcttttcaacgtaagattcatcctgcatcagagaagaataagatgtatcactgcatttttcttcacagctttatgtgactgctaacagggtcatgtggttatcaaagccgttttctcacgatttattattaatatgtatttctctattgcagttttctccccaatcccataccttaaataaaacatactgttaaacattaaaacttgaagtct

SEQ ID NO: 1696 - DNA, 797 bp, Homo sapiens
ctcaaagttttctttgacatttaaaatacgcccaatttttaagttttaaaagaatactttttcttttatgtcacctaatagacaaaatgaataaaggaggggaaaaaatgacactttttcttccataactctaagtttggctaaatgttacaaagaaatgtatctgtcctccaaagcaaattgtatcttctgatttactattaagcaccagtcactgaatattcaggcaaaccttcaagaggcagagagaaagcctcactattccatactcctgttctctatccttttgaccctaagattcaaattgattggacacacctgactatactaaaacttttcagtttgacagctctagaggaaggcacagaccatgtgactaccacaagggtgcccttgacagaacagcatccagcttagccccttagggcaagtatgcagaccactgcatataaattcagagaatgtgtaaggatggaaaccattttcctcttcctaaatatgtatttaaataccctgcttagagctttattgcgcaagcaaggttcatttaaaacaaaaacaggattaggaatcttcttcaaagcctagaaggctctacagtgtctggtctccacaaatagtttttccactgtttgccattaaactttctaacccagaggctaaaaaaatgaatgaccactgttttttgtttcttctttaatatctcacacttaacattaaaccactatatcttacctttttcattttggggggaaatacggtatttattatttctttgccaagactaagtgcaagca

SEQ ID NO: 1697 - DNA, 132 bp, Homo sapiens
aatctcacaaggctactgtgggggataacaagacataaagactgtacaagcagtttgcataaacgtcctgcccttctcctttaaaatgtgttctcagcactttctagatctgtgtaatatgattccctagga

SEQ ID NO: 1698 - DNA, 347 bp, Homo sapiens
caaaaaatgctagtcctgacttacaaataatagttccttttccttccaacttgaagctgtgctactgaacatcttcatgttgtagctttcgatcctgccatttcaatttgtctttgagtacacatctagacctgcaagctccaggaaatagacttcctttctgctggctccttcccttaaagtttgaagaagatgccaagtgatctaatccatccagagaagctatagtggcaccagatagtaccataaagagtatgctataataggtttcaggtgtttctcaattgcagttgtgtgagatacactctagcctcaaaaaattaacaggagccattggagccagaaga

SEQ ID NO: 1699 - DNA, 72 bp, Homo sapiens
ccagaagattttttaagtgctaaaatccttggcaggggacacaataaaataatacaaaaggcacttaatggg

SEQ ID NO: 1700 - DNA, 1306 bp, Homo sapiens
ctacaaaacgcactcactaaaaacagtcccagggcacattaatgaattctgcagaagcaaggggtcaagagcaattgggagaagttatgtatgaatcaccataatattgtgacaagtctgaactaagccctcaaaagaaggcttgtttttgagggttttttaaagctatttttttaatctttaagtatcaagaccatgtttatctgtagccctggaatcacataattctaacaagcaacaatcccaatttttcagtcattactgccaatttgggaaagcaattcaccatcttttatacatcttgggcccaaagggcagagcacaaatggacataaaataatgtctctgctactctctgggtctcaggagtcatatttttagggcaacctcttcatatcttccacggctgctaagcaagcactttcctctccagtcagtgcagtctttccttgagacaccacggtgacatgtgtctgtcttactgctgcttccctcctcttgattccaccccaaggcatccaaaccttacaggcttgtcaaagcccactttaacttcataaatatctcttctttactagagcccatatcagtatctacctgttttcacctttacttcttatcagctatttaacagatcaagatactaattataacaatgtcttacctctaatggctttaaatgcttatgtcttatcttcataataatactgagttcctcggcaggacttcggaaagttattttactcacgcccactaatggccaaagcaagatcatttttctttgtgaaaaactactgttaagaagagctactcatagaatatagataacaaaacaaatatattaggaaattagtaaataaggtagaccaagtatttagagtgaatataaagtatcttctttatattcagttgacagtcatatatgcatatacttggactgaatgtcataactgttaagtaaaaataaaggaatggaacaatgggcagagttatgtataccactggatatactatctgcataagaaagggaatatatacatatgtatttgtgtacatatgcacagactaatctctgaaaggatggaaatgaactggtaatagggattaacactagaagaaaaactgggtggccaggcagtggatatagaagacttactttctcaccctataccattttgtgctgctaaattttgtaccatatacatgtattttcaattccaaataacttaaataggacagagagcttatctactgaaaggaaaacattttttaggtatacatactttagtaaattaataaaataatt

SEQ ID NO: 1701 - DNA, 260 bp, Homo sapiens
ggaaggaagaaaaacaattaaaatgctctgctgtgcatatgaattattatgataaagactcaaacattcatccaatcatttcttgggtaattctaaatgccagtctctatgcaattttgtaaagagataaattattttaacactttataattcataatcatttctacatataatttaatttctacatataatttctacataatcatttctacatataattataaacattaactttattagtgaaagcagaataaataact

SEQ ID NO: 1702 - DNA, 162 bp, Homo sapiens
agtggttatgaacctggaaaggcctgaatttaaatccaagatcctagactttgtagatgcgtggttctcagcttatgacttaacttctctgaacactaatatccctcttaagaccagagttcagcaaattataaccccaaggcaaattacatcctgccaccc

SEQ ID NO: 1703 - DNA, 151 bp, Homo sapiens
cctaaaagtaaaatgcatacaaaccacatctactttgaaattgtctaagaatataaaatctcatgatatgtatcctagagcaaaagaaaaagaatttaaaaaagactaaaaattttaaaaagaatataaaactccactccatgcaggcagc

SEQ ID NO: 1704 - DNA, 82 bp, Homo sapiens
tattattactattttaaaagtcagacataactttcctcagttttatttggtggtggtggtggtggtgggtttttttgagatg

SEQ ID NO: 1705 - DNA, 222 bp, Homo sapiens
tgctatattgtaacttgagtgcaacacagtggcatgatcaattagtcaacaagaacaattgggcacaaggggctgaccttctttatatacttggcagggtttggataaacagagtagagaatatacttggacaatcagtgagactaacaccatccagcatgcaatttaaaataaaaatgtgacaaaaataactataacaattagaagttccccaagatactt

SEQ ID NO: 1706 - DNA, 247 bp, Homo sapiens
aggatgctgaagtccttttctagtatatctagaaataactatttttaaaagccaaaatttaaagatttcactaactaccaagtactttggaggaatgtatgtataagaatacatatagcataaaaaaagattctacacatactcctgtattaaaatagtggatatacctatatgttagaatataattcaactatcttataagtctatgtggttttcaacattttctaacatttaataaatatattca

SEQ ID NO: 1707 - DNA, 697 bp, Homo sapiens
taataaatgcattcaatccttttataatcagaaaaatacacaatagacttgtttaaatgtttgggatgatctatgaatacattttttttttaaaagtgctattaatgaagtttaaaaaagtgaatgagtgagtgatatagaattaaattccctccaaagaaacattttagtacttcattaaatagaaggctaaggacaaaagaataaatggcaatatttgtataattagttacttccaatgacagactatgccagtaaactaaatatagagataacaacttattttactcccaattttccacttattctttctaattttctttatttcatgtcaaacattcttatctagatcactcttttcatttcaagctacagaagtgacaagtgcctaagaaggggaaaaactttcacttttgggggtatacttatgaggaacaggtgaggagcaagcaaagtaaaaagcaaatgagtaaatatgtctctacatgtgttgaatcatgtccatccaaatgagaaaaaatatatagaagtgttggtggtttgtaaggaacttgcttctttcctcacctgataactgactctggatccacttctgcctgggttgcttttcacctaggctgcctccgttattacccagagttgctctctcatcttactattaaagatacttggctcagcactacttagaacttcctct

SEQ ID NO: 1708 - DNA, 448 bp, Homo sapiens
aaaattataaaaagaaaaaaaaaagaactccatattatatgtgaaatattgaaaatggactaccacacttgtagtgggtcctaatagtcaacaggcctctttacaactacatatgaatataagaccaaagtcaaacctctgaaaacatttgatctaagggagggaatgttatgggagttccagcatctgcttttaatgaatgatttatagaacaaaggacctgaatacatgtaaacaacatcaaatgatttgaaagaggaataataaaatgttacacactactatccctaaattaggatcatttaattttgacaagttgataggtttgattcagaaaactgcataaggtactatgagaaccaagaaaaatttatgaaacaggctttcaaagatttatctagtcattcattcagtcatttacatttattatctcatttaatcttgtgca

SEQ ID NO: 1709 - DNA, 1196 bp, Homo sapiens
cacctgcgcaacaaagtggacatcatccctactcagggtttagaaacgaaaagcacagaagcagaaacatagcatatggtgagtagaccagtttgattatgcacactaagagtgtaattaagaatgggagttataataaagtctgaaacttctgtcatttattttcagaggagcaggctactggttggcaaattcagatccatcaggaaaactcgtaataatgcatatgttcatcacttcctgaaaacgctgcacgtacaaaaagtcataattcttgggctaaaaatttagaattctgagcatttatcatgtgggtcaggaaaactggcccctgttcctctgcctcccttcacctggcatcaccctagcctcagttacaatttggtccctcagtaccttcaactgattctgaaaatgcctgacgtgttcaaaggagttactcctgcattcctccttagttaaaggagatcaaaggagatcaaatatacaggatgccaatgtctcaaatgaagactacacaatgatgtagccagaagaattaagagagctctgaaacatgtaatgcttgaattttatagcaagtcaaagcacaaatacagaactcttggttctgcatcatctatagagcataccttgtattgtacttcaaacactgagccatgttcaaacttaccagtgtaatattcctcaaaggaagaatcctctagtttgaaatgtacttaatgatttcatcaatttttactgggtatttttagcaccacgtgtttctaagggatggggaaaagggtgagcctttccactcttaaagtgtcctttggtaacttacctttttgaacctacaaaacatgcttgaaatgatcaaggaataatgcacgacagtacatattcattctactacctgagcatactcgtgttcaagtcagtagtatatgctctcagagaaggggtaaatggagggctgcaggtaaagttgcaaacgtaaaagtatatacaatcccaatttttctattttcacatattgttaagagagatcataatgtcttgtttctttcactgaagaattccagttgagtgtgatatttcaatcgtgaaattaaagcccagaaatattatttattcaagaacacaacaaatcattagcagaaaaaagttatttgaaagaggtgaactattttctgatataaagcttaaattct

SEQ ID NO: 1710 - DNA, 916 bp, Homo sapiens
aaaaaaaaaagaagtagaaatgaaggtgtggagatgacatgctacactgaaactgatgttttaaatcacagagacaaatcccaaaatttaccagccaacagcccaattcccttttagtgataagtacctcctatatatgtagtcatttttttaaaatctcagttaacatggacatacttttagccaactgttttcaattatatatactgcgatgtccgtttatttttctacattctcaataacagttaacactaaagaaacaatactactcaatttcaagagtacataattatccctgaaatgttgcctaacaatgttccctctagggtcctctgtgtgcaaattcctactttatatatgaagcacgtttaagatctcaaaatgtgttgaggctatttctactacaagaattgcaattcacaatccagcatgacagggcacaaagtccaacagtactgtaggctttctattaaaaaatactcatagtaaaataagggtcacaaacagcccaattgctcaaacttgaacaaaccactcaataatgaataacactgataaataaccatacaaaaccaataattataagaatcaaagatctcaacccaattagaaaatagtttaaaagatcatcttttaacatcaagataagaatggtgaagagactatttctattttaatgacataacccaatttttgttttatgttagattacttttcaaacctcatttaccattttgatcctaaagcatatgaaatagatttacaaaggaaaagtatgtcctattcagtttaatccaaccttttgtgctgggaattatagatcctgagtagaaaaaaaggtaaaattatgatgtacactggaaactaaaataaatgattttatattaaagattcaatttaggagtaatgtaggaat

SEQ ID NO: 1711 - DNA, 425 bp, Homo sapiens
aaatcttacttcaggggagcaactcaaagaagagagatggaatttaacttgaattgccagggaagacagagtgggtgggagagaaagaatatgaacaatgagaaaatgagtttagactatgctagaactgtgaaggacaactctggctggataaaatggcttctgctggggagcagaaatgctagacaacgcttgggcgatccctacacaattgacaccacattatgttcttctattggagagtgcttcaccaaaagtagtctaaccaaagtatatacgagggcagagtgatttgaaacaaaagaaactacaagtcaagagacataggcagaagacaacaaaaacagacctaacattctatcaaggaggcagctccacagtttccgtaaaatgtagtattttaatttagcagttttccacgataa

SEQ ID NO: 1712 - DNA, 1360 bp, Homo sapiens
catgatattctttaaccataaatatcaagctattatacttcaatcttatacaactgttaataaaatcctaaatgaagcatgcaagccacacttaacaggttctcagagacagatctaataatttctacgaaccatacttaaaagctttatttttataacatcatttaacactccacaacaaatagtcatattgttataatatacattatgcattttcaaaattttttcctttgactccataaaaggatagcaacagaaccacaatgctagtaaacaccatattttcaaattcataccaaaatcatggtgatttcaaacatttggtaagactacttctttaaaattagaaaacagctgatgtcattattttaggggtaaaatcagtatacgatatgacatttcttatattgccattatgtagaaagatttatagtagaaacacctaccttatttaatgcaaattgtgtatataaaaactgattcacaaatatttgattggcaagctttctctagtacaagaaattaccaacatcataaaaaattctccttatttttttctaaatattactaccaccagtttcactactaatagcaaacagctaccattacacaataaccagatgttaggttctgtattagctactttatttatgctatcttattcaataccataaaattcatcacaaaaaaggcaagcttaagtgagtaatttcaagcttaatagaatttatgtaatctttttcttaacattttaaattgtttccttaaactaatgaggaaaaaaatgttagaaaaaaaagtgtaaagtcaaccaaaagcaaaaatatgaaactgtattcttaaccatctttccagaaatgaatattcttgtcgaaagagaaatgttctgaaatctaactctaatctacaatgctttccccctgctgccaagttgctacacagatgccacagtcagaaaattttaccaagtgtgatcacacttttcaaagaaaggaccccatttactaacagcacactacgaatcaaacaggcagccatccctcaatcgcctccattccccttacaatcctatcatctgcctttcagccttgtttggtcacctcccagaccttccttcctcttactggtctgtctcatttctcatcatcctacctcattctgcaaaaaaaagttcataagggctgttaagaaacatttgtatagagcactaaaagtgcatcaggaaaaggttttatataaatgttaactccaaatatataataaagatcttttatgtctatacattttttaaaagatggtaccctccttgacaaaggatggtatgcaacgtcaagttttacatcctaaaatacgtatcagg

SEQ ID NO: 1713 - DNA, 83 bp, Homo sapiens
accaaaattcagccaaaattaactccttgcttaaaaaagaaaaaaaaaaggagaaaagaaaaggccaaatcaacaacacgttc

SEQ ID NO: 1714 - DNA, 70 bp, Homo sapiens
ttccagttatttaaatcttcttttaaaatctgccttcttttatgtccacaccatagtagtgttcactaaa

SEQ ID NO: 1715 - DNA, 1486 bp, Homo sapiens
gattttcactaagtcttgactataataatataaaccagaaactaaatggaaatgaaaaggatgatatcatctaaacatttgatattattaaatcaatgggttcagtctgaaaacataccataagtattacagtatccttttaggattagtaatagaggtggcagaaatatatggtagactataacaggaattcataagtaataatctcaagagtcttaaatttttaagccacaatggaaaattaatttatacttagtacagctgaaattttccaaattaaaattaagacaacattcccctctcgcctacacagatgaactgttttctcattttgtaaataaatacaaaataaatgtggaaatgaaaaaatatagtaatagcataaaaacaggagcagtcatttccctcagacaagtctgtttttaacttgccataaaattccccccatgttactgagatgccatgaaaaaagaatggaaacaaccttccaggcatattcatttttacactttctctaaattctaagatacttcagcaaagtatgccaaatttagctacatttacaaagcagaggataagacattcctttttaaatgtagtcaacttctagagtaatccatttcattaatctatgagaatgatctagttgatatactgcaatatcattctacggtacttaggctcagtctattatttggtcagaaaaacataccatgaacaacatcctaaatgaggctgagatatgagtaaactgaacagtacttccctcatgctaccaaaaggttaaactttgaacctttattcattcatgctctgaagcttcaactgactttgtttccaacagggaaagtggcttttggctaagacaccttaagcaaaggtgaataggtggtcacctctgtaataaaaaactgaaattaacacctcaactcccatttgggacctacaatttctccttccatttcttgatctgattatgagtatcgttactcaagttaacataatccttccctctctacaaacatgttcttttaaaattttccaactcttgggaagaatgatatcaaatctcttgcagtggtgaatacaagagttactttctgcttacagcagaactaaatacaatgaaggtaacatgctctgagtggtagagaaaaaaagaataaaagatatggatatatacagagacatacatggataggacatgtccagacttcaccaacttcacttcacttagagaatcagagaatcagaaagctaaaagacaacttagaaataaatgctaaaactgaagtcccaaaggattcactaggtcccacaaggtcaaatagttaatggaagatcatctacatttccggatgaacggtctattgaacaaggagagatttgttttgagcttagtttcagttatttagcaggaatttaaaaaggaattacaataatggtattctctcaacctctccagtatattaaaaaacaaggtata

SEQ ID NO: 1716 - DNA, 472 bp, Homo sapiens
caaggtatatcttttactataaaaaagaatttaaaaaacaaggtatctcttttactataaggtattttcaatccttcttgaaaatagcacatatttaaatatattttactttaaagtgtaaaaatcaataattattgttgacatatactgtttagaccactaatagcacaaatgaaaaataaaaactaacagtcataacttcttttaagttattaagaaaaaaaggaaaaactagaagagttggatagaaagcaaatactgtatttaactatcatcacctctggctgaagtggtctttcaatttaacattcccctatatatgtttatgaaactacagagcaaagtacctggtacacgaaagatactttttaaaattatagctaccactattaagctttatcacaagcccttattaagtgtttgtctgctcccttcctggaatcaacagttttgtgttttgcagctacttgta

SEQ ID NO: 1717 - DNA, 656 bp, Homo sapiens
taactcacttttcacacaatccccaaatatattcaaatggcagaatactgtaactccctcagatagactctcagaaaatgagtaaatgttttatagagctaccaaaaaaaagctgtaaaactattatgcatgattatgtaagtccaaattgtcccattaatatttgtctatggacttcccatcagcaagcccttattaacagataggcaccacatgtgcaaagtaaatttatgagtaaaacagaaaaaatcatagatagctactgatctcatttttctggacactaaaaagaggcttgctttaccgttcacacttgaagtgtctgctcaccttctagactagggatcccttctccgccttcttatctgggcatctctaaaagctaaataacacagatgactgggctataacagagtctggggaaaaagaggaggatggagagaaggcgtaccactcaagaacagggcaggtttgcccatgagtcagtgatagctaattaattcagaaaatggaatagcaggttgttatctttgaggagataaaggggaggggaggatgaaataaggaaaggaagggaaagtttcaaaatactaaatatggttctcctacatcaaaacatttctggtatgagttaataatgtattgttacacaaaat

SEQ ID NO: 1718 - DNA, 940 bp, Homo sapiens
tggaaagggtagaaaaagaggaagattctccagctctgccccaactccatggtggagacagaatggactatcaaaacatgtaaattttttggaaaagaaggaatgagttaaataaaaaaattttgaaaactccagcctaaatccacttggatcaagaaagtccttaggaataaagttagtggtggtggtttttgacaatgtcactgaacaaagaaaccagatttagggaaaaacattttggaaactccagtctaaatccgcttggatcaagaaagtccttaggaataaagttactggtggcaatttttgacaatgccgctgaacaaagaaaccagattagagttacttgaacagctctgtcctatggcggggggtcttctgcagggggataaggctgctcttgagagctaggggacatggttatcaagataaatgaaacaggagtacctccttccaccacaggcaaagcctctggcaataggtggccaagcctgggctgatcatatccaggttgtaccatttgctacgctgtgtggggtgcagtgaaggtctgtaggttgagcctgaagaactcatgttggccaaaccaaaatgacatttaatacttggacttgctggtgcttgctgtgtaaagagtccttacagaaggtggcacacacagagatgacacagagaaagaggagcctggtgctaccaagtcaggcagtcttgtttcttgtcttcctgtactctgtacctcttggaggtgatgaaggccaaagagacccttgggagtagcctcactttccatgctaatctgcatgcatgagaatgacatcagtgagtactgctgacattaacaaaacaaaataataaagtcttgaaatatgcatcccccttatgaactggacccacataatgcccaaatatgctttgtgttgattttgcttttggtccaatt

SEQ ID NO: 1719 - DNA, 232 bp, Homo sapiens
agctcagggctgaaatctttgcaaggaagatttatcatgtggattggaatgtatgttagggcagcttcatgtcctgacagactgtgggggattgctttcacgttaaaggatgacaatgacaaagacttgagatgcattctgtgacaaccatttgtcatgaacatcaccacacatatcacctcttatgactggaggtggaagatccttcagaattaggatctaggaggatata

SEQ ID NO: 1720 - DNA, 358 bp, Homo sapiens
aaagagtgggggtgtatttctatttataaaataaatattctaatgtcaacgccatttcatggcataggttagtgagttgcatctctggtttaagtttaacaaagggtaaaatacggcagaaggtttgtggagcataattttcccaatttgctggcctggagttgctgtgggaaaccatggagaaatcataagtacttcctaacttagagtgctgcctgtcttagggttcctctgatctcttgtggccaagatgtgcagtaacttagaaacaacagaggagttgtcacgacttttaagaaaaatgacggtagatataaaaatatctattagacctgcttttaagtgtttttgtaatgtg

SEQ ID NO: 1721 - DNA, 206 bp, Homo sapiens
gatatggactctctaaaataagaagctgtaaaagagaaatgttagaggaaaagataacttttagaaatagcggatgatctttgattcttggcatagcatctgattctagaagtagaaatttcaagatgccctttgccttgattttccaagaaataagtttgtgtaatgaagctaactattcacacctttctttaacactgatcttg

SEQ ID NO: 1722 - DNA, 159 bp, Homo sapiens
acaactcatccttacgaactaactcagtgttgctggacttatcactgggaagaagaaacgggagcccttcatggttgccaggagggtctcaagtacaagaactgctcacctccagctggacactacagaatccttctctgagagtcgataatcttgcac

SEQ ID NO: 1723 - DNA, 69 bp, Homo sapiens
cattggcagaaggtgaggggaccacagccttaaatataagtctctcgaatgactttaggcagttccttg

SEQ ID NO: 1724 - DNA, 108 bp, Homo sapiens
agtctgtgcattctcctcactcattctgtaaatatttcctgagtgcacaacaaatgcctgctacttccacaggaaaacagcacagaaccggtccctcctctcttagct

SEQ ID NO: 1725 - DNA, 181 bp, Homo sapiens
ctctcttagttcttttggcccaatgcaagagtcagatactaaacacataattacacataattacacatggggctataatcacaaaataaacacataattacacatggggctaaggtatggtaggaccatccaaggtactgtaagaaagatgtaagagatgagttagctttgattcaggcta

SEQ ID NO: 1726 - DNA, 177 bp, Homo sapiens
ctaagaatctcattcaactttctttcagggtttgtcccagatattttaagtagtttatgtaccttcagagaaaaaagtgggattcaagacatagtggaattcaattgggaaaaataattatttgtaaaatctggattattgacctctttttttccctaaaattttaaattctgattc

SEQ ID NO: 1727 - DNA, 456 bp, Homo sapiens
gaatacgcatattaccaaattagacactgactttaggctgataggatggtgttaccatggataagtgttttgtaaatgtctcacctcacttttcttctctctacggccagtggggagcctgctggtgggagaggtggcgattcttagggcctcagattccatctgcacatcctctgcagcctgagcctgcctcttatgcttgtctgcaatgggctgttaccaggtggaatacatcccttcccatgaactatctccttttccttctacaggataaaggatggaagcatttaaataaatcttttgggtaccagcgggactgaggaacctgtgttgacaggcttggtggatgctgagctgctcctaaccaattgggattttgcttttaacttaaccaaggggataaggccaattaagttcctttctgtccctgtctgcgtctgtctctgtctctactac

SEQ ID NO: 1728 - DNA, 37 bp, Homo sapiens
cctgtcttctttgtttacccttaatttgggaaagaaa

SEQ ID NO: 1729 - DNA, 260 bp, Homo sapiens
ctatataaatgaataagcacatggcattctattcgaagagttgcttttgctctttgtagagggtgcaggggttgaaggaataagggcaagacagttggtgcccattgtccaggtactctcctggctggtgaaccccatgacacaggaaatgacgggtgatggaggctgttcctggacattgcatgagtcagaggactcctgccaagtgctcctctctatcttaggtgcactgcttatgtttttatttaattattactagg

SEQ ID NO: 1730 - DNA, 1358 bp, Homo sapiens
caaagtgctgggattacaggtgtgagccactgctccaggcctgctcatggcttttaaagcaactccacatgatgcaatgcttccttcccagatgaatgtcattttaaaagcttctttcctgcttcatgtggatagagatttgcattcatccctcctcatattaattttgcattatgggtggggatgaagaagagcattgtccctaaagcgagtgtcttcaatctgtttataattcatctctcagccagggagcagagtccgtgtcacctgaagaggcagacgctcccctgccctggtgtctggaggcaagacggcgccaaggcggaggcacgggagcatctttcattcctccccccatgcttgctgcttcatcaacatcaacgtcctgctgccagggctgatgaatggctcaggagcgtcacagctcggtggctcttatgccacgtgcactggcagctgtcactgccgtcctacctgtgacccacatgtgtcttcctgaaatgactgaaaacaagctttcccctcatatgttgctatcttctcagagtcaatcagcaatgctaatcaaatctgtgtgctaagctaggattttggaccttcttacgtgaaggcgcctgaaatgaggtcccctttcctgaaggctgactgttgttttgtctccaatgagtaaccccaagactgtgcacagtgagcaagaggaaggggcagaagatggagggtggaggtggcatgtgagctggggtccatcacacactcaggattctctgtatgcaaatttcattcccaatgcaatgggtgttgttgaagactttgaagttcaggggcaaagtctgatttactctgtaaggggattactctggcagaggcttgggaggatctgggggcaattgggagctcttggaattgtcaagataggaggagatagatggtggtgtggaccaggttaacagacatggggggatgtggacaaacctgctgattatgagtctacagtctgcattagtagctgtgggatttgtcccccttgctgttcatggctctgctgatcctttgggtaatagagctgatgggacttttgtggttcaatctccttgaggagcccttagtaatcatttggcttctagtaagttaactccaaatattcccagattattcacacaactgtgtatggccagagaaaaatggcttctgctgatgaaaactggagtgtgagccgattgaagaaaacctgcccattatcgagtattgatgactggaaaataatggaaacagaagccttggggatgctgaaaggagacaacagttcttaaatcccccaaactagctttcttaaaagcaaaagtattctaaaatttttg

SEQ ID NO: 1731 - DNA, 212 bp, Homo sapiens
tgttttttcaggtggaagaaagtgattattaggtcattgtcttaaggcaacttactgtcttactcctttgtctttgattgcctttagttgtagtggccaatttctagtgaatgagaaagaagtagaattattctgtggggatttgggaaagcatttgatttgctggtaatgctatccttttctgtcttcccccttcttcttgccttgaatac

SEQ ID NO: 1732 - DNA, 220 bp, Homo sapiens
caaatgttatcccatttaatccacaagtaaaacttcctttgttacagaggtgggaattgatggtatttaccatggttcagcttgtgagtggtagagccacaatctgtgcccaggtaagactaatcattttcattttaccatgtggcctctcaaaaaaatgtcggtctcagagaataagtccttaatatagcatgttgtggattatttagaaaactagtct

SEQ ID NO: 1733 - DNA, 234 bp, Homo sapiens
tggactataattttttgggggggtagacataatcttttatatttttcttatgtcaagcttaatatggtgagcttatagcacacacacaaacagacacatgcacatacacacatgaacacacgcacacacttagccctcataattctcttgcaagagacagcaatcatatttatatgcatccccaaattgcaacgagtcctagtccctacctagtcacttaagaatttagccact

SEQ ID NO: 1734 - DNA, 254 bp, Homo sapiens
ataataataaaaaaagaacttagccactttagatttccagggttttctttctacaaaatctcagtggggcatctcacctgagcccacaaactagcctttatctctcaccagccaccatccaggaagagcccatcactgtccctgctgacagtgcccattatgaaaataccaatgactacacttttccccaaagctgtcaagctgcctgtacataggatgcccaaagggtgtttgggtccttcatagagacagag

SEQ ID NO: 1735 - DNA, 105 bp, Homo sapiens
aactagcacattcacataaatgtatttgataaacagcagccctgtttgttcccacagccacacaaagtgtttgatgaaaactggcctatttgctttcctgaaata

SEQ ID NO: 1736 - DNA, 299 bp, Homo sapiens
ctctgtattattataaaacgggtcttctctcttctaaatagagaaactaaatttagtccagagtcagatgggaaacgcatgccagcccagcccctctctatcattgcactgcctctgcctgtcttccctgcatccaaccaaacagcatcctccagttgcagaaggaaatccgcaaaacgtgcatgttcacgggtgcaagtgttgccacttccgtgcagcatttgcagagcaaggctgcctatgcctaccccagctggagcaagcttccaaggagaatattattccagctttattatttg

SEQ ID NO: 1737 - DNA, 295 bp, Homo sapiens
atagaaagtcctcctgaggggaactttgaagatgacataaaaagactaaactcggccataaccatctgtagtaaaatgatttggcatagctgcgatgacacgtacctttttaggggaagggcttcaccagggtgctgggaatgaagtcctggcccctcaaggccaggtgtgactgcacttagatccatggaaaaggtggcttgggagatggcatgtggtgcaagagggcaatcatctcttgggtatgtccacagaggcttattaataatcaggagacaccataaagccttcattc

SEQ ID NO: 1738 - DNA, 258 bp, Homo sapiens
gtgtttgaatggatacatggaggagaggaaggagcaagccattggaagagaggccacagcaagcactgaggcatgcatagatgggatgggttggccaaattctgtgtctccacgttggacaatggactagagagctggtttgtcacctcagtgctgctggtggagcaacctgcaatggagggtggggacccagaggtggagggggaccatgaatagggtgggtcctggaggaagtcccaggaggagggcacggaacag

SEQ ID NO: 1739 - DNA, 1012 bp, Homo sapiens
tgtgtgtgtgtgcacttaatattattctaacattcccagggaactatgcattagctctcagatctgaaaacattctgaaaatataagcagcattatgagtagatgagcttcttcccatgctcctcttttctcttcttactcagcaacctcgctcaggaagagaatgaagaagggtgagaaaactctgaaaagctctgcttagcaggattaaaataattgatgatgtttgaaatagagtccaatttacatcgtcatcaaagaacccaagacgaccactgtctctgcctgcagttgtcaggcgatgcaaggacattttgtgactgttcctaatattgcctctttcagagatcctttttttaaacgccaagaagatgctcattaacatgagaatcttccctcagcatttggtcaatccattaacacttactgaacatattacccccaaacctcttctctattaccaatctgtcatcttgggaatggaagagaggcaacatgagggtacagccaccgcatggaaatgttttgatgtgtgaaggagttgcaacaaaagtctgaacgatatcaactcatttctttggaaggcactattattttggctttctgttagagtcttgctttgattggcagggaagtgtgcatgtcattaagtagcattttggaaaggaagagagataattaagtacttgagggtcatcccctgtgacttctcaagtgtgaagtggtgaattctaacctgggactgtcaaagcatctgcatttgatggtgggaggaaccacctacctggtttccattagaccagaacactgtagcaagtaagggtcttatcctgtaagcttacagctaaaactatatggaaataattgatatttcagttttccatgcagagagactctatgtgtgatcatatctttatatttggaaaagggaaaacaaaatccctttcattttaatgttgaatttggtcactttacatgggccttggacagaatttaaaaggtgctagatgtt

SEQ ID NO: 1740 - DNA, 324 bp, Homo sapiens
cagagtaagactgtctcaaaaaaaaaaatgtgctacatgtctcccatgagacagtatctggaaaacactttgtgacacctgttaacataaatacttcactgttaactgattccaggagtgtccctgaaactgccatgccaaataggaggatggtgtaatggaaagtgataatatgatgattatttgtcccatcccaccctgtaggttacaacaaaaagagagggcccagtctccttctgatttgtctatgagttagtcacagacagatgtttacaaaaacaatgtgttctgtggccttcatactctagggaaagatgttacaac

SEQ ID NO: 1741 - DNA, 244 bp, Homo sapiens
gattctggtttcaatcagcatttttgagatggcatatatttgactggaatgactcaatatgagtcttagctaggcaactgaattttccagagtgtactattagggtaggagagaaggaaggtggggaagacatgtttaagcaggtgtaaaactcaaataaggcctcacatatagtcacttaactttatgtcaaaaggccatcattatattttggagcatatgcttttaaaaatgcaataattaa

SEQ ID NO: 1742 - DNA, 844 bp, Homo sapiens
tgttagctttctcagattttaatggatacagagacttataataaagccctggtcgggttgttctgagatgcggcccagccctcttttctggaactctcacctttcccagcctctctcctatacctcgctccacattggccccattaacccaaaatacttcaattaaccttatccttcctggagctgaactaacaaactcaatgctggtggagtggcagggctccttatacaggtcactaatagtttaatgcccatttctgcctttaggttgtgagctcattctgttcggggatcacatgtcaatttcttcattattgtgtctcagcatctcttataagactggctctgacatacggtcatctttgaaagtggattcataagatcaaagcacagtcaaattgaaaattttggcatgatgcatctttgcaatcaatacaaatgaaaatgcaaatagaaaaaatgaccatgcacaacatggtatgttgttaagtcaatttattctgttcatttgtggccagcaggcaacagaaaaataagtgagcttcaacagtagcagttccagttccttacaaagatttctgaataaaaatctaagctttgtttgctggctaaaaaaatggaatcttctgtacttgaaggatgtttttaaggaattctccctgtgctcccctcatttttccctcttgcatgaactcgtccctgctgcttcagaccatgttgactcctccgttatcttagctcctctgccagcactcagatggtaaaagctctggattatctcaaggtgttaactccagggtctcaagggtctccagggacccagcagatgatgtgaaatgtgact

SEQ ID NO: 1743 - DNA, 432 bp, Homo sapiens
cacaatttttaaaaattctatatcagatcaatacaacttgtcccttcataggcatcagcccttgagccaccttttcattatctcatttatagccttaatttgttttccatttctttatggtgaatccaagcagagtgagctcattaaaggctgaagcaggctcccattgcctctgagcattttgtacctttcctccctctccacacaacggcatctcgacctgggccaagcacaggaggttaataggtactgattagttggttgattgtttcattaaaaagatagtgcagatgctgcaacctggcagcccttgagctgccctcaaatcatagtcatgtttcatctgatctgcacacagcacaggtggccccttgaatagatttgcagtttattagtccatgacagtttccattttcattcacttatttgttc

SEQ ID NO: 1744 - DNA, 72 bp, Homo sapiens
tttaccactaaacttactgtctctccccaaggagagatagaaacacccgagcataactcatatttcataagg

SEQ ID NO: 1745 - DNA, 239 bp, Homo sapiens
cataggaattcacttccaacagtgcccatgacatcagggtcaggtgtgcaactggccctgcaccatcacagctctgctgttgtttctaaaccaggcttacatctgtcatggacatcacctgcctggcccatgcagtcattctgttgcacaacccccagttgatagcaacagtgcaggactgaaagaggcaaaggtatttggaggtgaaaaagaaggcccatatattttaggttgcactc

SEQ ID NO: 1746 - DNA, 566 bp, Homo sapiens
cgaaaaaaaacaaaggggcatgcataaaacactattattattttaaactcaggccttgagaattttaacttaaaggctgataagcaaaccatcagggtcaaaccaatcattggaaagtttctaacatctccaatgttatttaggtaaatacatctgataatcctttaaaggtcagaaaaggttacgggtcagatgcccttaccttggctttccagtaatatggaactaaactgcgcaaacgtttgtgatcacgtttattatagtttactagaactacagttgatcatctggcgggaccatttactgagcataccgtgtgcatgaaactgctctcctcgtacttattgggtcttcaagggtaagaatctgacttccccttgcattctctactgttcccacccaaaagcccttgtagagcaatgatggtactgtctaggttaattctgagaccctgatgcggactgggctttctctaagctaatgaaccaggttggaaattgcaggctgtatgactgtgtctagatgtgccttttcatttccctttgccccaagattggctaaagtaa

SEQ ID NO: 1747 - DNA, 832 bp, Homo sapiens
aaggccatcgttaccacacaagtcaatattcatcatttctgctgaatggctaatattgctttctgcaaagacctgctccaactgtatttccttaaactaatgcagcaatgaatatccttgggcctatagtgttggttgctattgaaaaatataaattggatatgtccttgaaggtggattagtatacactttaaagttataaatattgttaaaaggttttcacaaagttaggtcaatttcccaccagaagggtgagatggaatctgttttcctatcccctaagcaaaattggatagtaccaatatcttgaccgttagaatggagtttgaaagtgtgaaaagatgttctccttctagagacctccctcagatataagtctcagtgacccatcagcaactgaagaggattacacttgtcaaaatgcatgggcatgtgtttgtaggtgtgtgtgttggaagaggctaagctactgctcagggacctcagaagctgtagggagtgccatgttgatgctaagtgaactttcttcaggtaagatgagagggattatgtaggttctaaaattgtcctgaactctcccaaaattcagatttgtttccaggcccccattagcctgtatgaacaaggaaattcaagggcctcaccctctggaacatggttccatgactgcctatgcaagaagaaaagttcttccaagtttaggggcagcttggaaaacattttagaagcttaatgtatgcttctttgaaatttaaataaaagcctctggaaaagttaggcagaaactcagatttaatacagaatttgatatttggtgtaaagctgaattttg

SEQ ID NO: 1748 - DNA, 389 bp, Homo sapiens
tatattaataaaatatcacttgtttttcaagatataatgactcattacaagtgtagagctttaaaatgtacagattcagttgttatagtggttatgttagtttgactaataaaaggctacacctgctactctttatgaggaataaactaggattatgcaatttttaaattatttttgattttctggaatttattcttttcagaaaataagcttactctctattaaaagcatatcacaaacacaaaagccttggtattccctgccttgcataagcactgaatggttttaaaatagcattggttcattgcaaaacagatgaaggggctagaagtaaatgaacattttaaaacccacataatataatatatttttactgaatactaaagatg

SEQ ID NO: 1749 - DNA, 42 bp, Homo sapiens
aagacctaccctattcctttcccccaaaagaacaacaatgac

SEQ ID NO: 1750 - DNA, 53 bp, Homo sapiens
tcctctgtgggaagggaagaaaagtctattataggccaggtgtgtgcggtagc

SEQ ID NO: 1751 - DNA, 129 bp, Homo sapiens
gtctattatacccaggacacaggtaaagaacttttgtgcttgggaaatatcaatgaaaagattctctagccttgagggagagaaggaaaccaccctgggtcgaaacattagacatctataacactgaga

SEQ ID NO: 1752 - DNA, 165 bp, Homo sapiens
tggggaggggggacaaaaacattcaatccataacacagaaagaaaaagcaaatgaccgaggaagctcctctttcaaacttgagaatgaagagaacgtgtaagtctgaggctagatcagaaggacaaggactctctcacctccaactaccagcagtaacagcaata

SEQ ID NO: 1753 - DNA, 62 bp, Homo sapiens
gaggggtgagtattagagtacctaagaggtgtgtgacaaaaatcatatttaagaattgcttg

SEQ ID NO: 1754 - DNA, 64 bp, Homo sapiens
gaaatacaagctgaagttcacattaaaattaataattaccaaaaaatgaaagtgccacaaatga

SEQ ID NO: 1755 - DNA, 800 bp, Homo sapiens
aagttttcatgtgtgcatgtgtatggtggttgctgcttttcattacttgcctgtctgaaaggttcagtttttgcctggaggaataatcctttaactctcccatgtagttggagtttccttgtaaaaatctctggcctgcagcctcagaagtaattcagctgccttgtgattatggtatatcctatgagacttaagctattttattttttattactctgaaatccacttggtctcagttttcctcgcaaatgaaagcttctgggcatatgggtaacttctcaggctgaatttggtgtccagaggccagttttggcactaagaagctgtcatttttcttcattttcttcaaaacaagttacattttattgttacattgttggagtaatcaatgttacctcatacctcaaagtcctaaacaagaccaaattggattgggtaaatcagggagtgttgggtgaagcggaagactgtggatgtaatttcctaatatattgtttcaatcttgtcctaagtatttacatttagtttcagggcttatttttcagctccctatgctgtaggttacaaattactgaatagaaggagaaaaaaataaatgtatcaggtaagtgggaatgttcctaatgcgaagattggaagattcggggaagctggttacacacacactgcttcagctcattgatggagacgtaggggtgggcttattcccattctcataattgtctgcagagaatcacaagcttgggcatgatggtcctctcaggtggctacttggctgcatagctccaaatttcctgtca

SEQ ID NO: 1756 - DNA, 767 bp, Homo sapiens
tattcttgtggttagcctctgaataaagagctcagaaaatctcaagaagaacagtatatatggtagtcttggagaaaccagaggctggaaaacaattttgattcttgagactctccaattaagattcaaattctaagaatccaatgggtttggcctgagtcatattcttgtcttcaaggatggttctacgaaggctaaatgcaattgggtgggagggaagcggaaggtggttcctccagagaaaattagaggatctagttctaaaggaagtagctaaagatatgggtggaaagaaaaaaaaattaaagcaattgatggcgtctattctaccttggagtataaaaaattgagatttaccttttcatacaaagcagaataaattaatctataaaaaaaattccctggaatattttttagaggaagaaagaaaaacatggaattgtggttgaagagtctgggaattcactgagtatggccctgttgcaatcaacaattattactaatggattattagcagtggtgctaatattgaattactgcagtattttgttttcctcataagtttctttggggtttggttaaaaaaaaagatatgtgtcatttaatatttgtggtacggccaaataaataaataaacaataaaagaacctctcatttgtttaaacactagaaacaaagcctaaagatcacagaaaatctttgatctttgttattgggcagatttaagtttactgactcgttgcaacagcagagaacacacccgatgg

SEQ ID NO: 1757 - DNA, 566 bp, Homo sapiens
agatgccttcagaaagtggaggtaacgccatgagaagacatctcagttttgcctttatttgaagaagtcatcacatattccaggccaacaggaaaagagatatctcaggaagccagtaacatactttaataaaatagaaaccattttcccctttctccaggttggaatgcacacagactgttaaatattatttcttactaagcgcaaacacactttttcacttttgtcaaaattagaatgcgtatttttgatgatatttcacaatcaccttcttgaacagcatattctgctaaaaaaattctaaaaaaatacttttatatttgtcactttttcctgaatggtgcagtggccaagtgacacattctgaaatatctcgtattttcatcacctgggctgaaagaagctatcagccgcatgagtgcgtttctatttcatgttgtatgcttcctgtttcttaaatatggatgataagcatgaagctggagctgcaagatgtttctctaattcatttctctggaaccaatagaaatcaatgtgtactttatgtatgaagtcaccttctactt

SEQ ID NO: 1758 - DNA, 557 bp, Homo sapiens
ccctttaagaaggagaacgtgagaatctcagtgaccttataattttgcttttgtagaagtaagagttcatatttgattccttggttgacatgagagagaacatcttttcaactgaaacaaaacaaaacaaaaccatgatggccatttgagagccccctgggaaatgattcttttcatgcatatacagcatggcaaagactcttggatgttctcagcatctgggcaaaaccatataccatttactcactgaacattatgccagtcaaattggaatggacatctgtctattgatgttcttgcatttctcctattagattcagaatcctccaagttcccaaacatcatcccttagagacatagcagatgcattttcaattttgtcttgtgaattattctgggatgtacttttccagaaatatcagtaaaggaactgtgaaagatgatgtcataatactgatcctcagttaatcatccacttgccagaaaggtgccagagagatgtgacggatgtgcaagctttgatcttcatgacattataaagttcacagatcaatgag

SEQ ID NO: 1759 - DNA, 822 bp, Homo sapiens
ctttacctaatgctaaatgacgagtcaatgagaattttaagaggcaattcagaagcaacgccatatcttggggcactggtaagtaggaggtgcttagcccattacagtgaaggttctccaaagctatggggatcaacaggaaactttaatttaggtcatattggtacagaatcatatttcacccaaataccctcttactccttaccaaataaataagtagattaatatcatactcatttcttgccagtacattttagacactgcagggactgcatgaaacctataaagtgcaatgtttgagctctaggagctcacagcctaattagggaaatgaaagattagaattaagatagtattccactgtgattagtagacaatctggcaaatagaacattcaacaagtccgaatgtgccaaaatccatcagaggtacaaagtggtcaaggtaggtatgatggttccaggatgccacaaggggtacaggatccttccagctttcttctttgtcatctgtagcttatcctattgtttgcttatgctactgtgagcttatcccattgtttgttttctcagtcacaggatggtcactccactctagcatcacaaccacagtccaaaagagggaaagataaacaaagagcagaacaaagtcagttgataggctcaccctttaaaaagcttccctggtaagcccctccaagcaacacctacttatatccatttggccaaaactgtgttgtggatgttattggctgcagagaggctagggagtgtgattttttaaacctgaaataaacttagaaggtatactttggatatctgt

SEQ ID NO: 1760 - DNA, 454 bp, Homo sapiens
ttagagttatcaagcaggaaatactaaatatgggaagaccactaaaagtgtttggtaggagcataaaacaaaaacagcaaggttacaattagtgaaaggcagcaaatacagttacccacaaaatgtttggatcgtaatgcctgcaaaaattaaaacccagtattcaaagacagaatattgggtatgatatagcctataagaaattttccctgttagaaatttctgaaactaatgctagagaatagaaacttttttgttttgggttgttggaactggtggtcattagctttttgccttgagtaatgaagaggacgtgaagtggtggtattccatttttagtaaactcagtgtcccaattctatttcctttttgtctataagaacacctccttaatcaactttcagttacttatcttataacccatccataaaatcctcttggatccttatagata

SEQ ID NO: 1761 - DNA, 62 bp, Homo sapiens
agcagtgtattgagagcattgccattgtttaaaagcaagtattgagaaccactagtctagaa

SEQ ID NO: 1762 - DNA, 48 bp, Homo sapiens
gaagattatgacctccaggccaggcatctactcatgacatcaggcatg

SEQ ID NO: 1763 - DNA, 48 bp, Homo sapiens
caattttatcaatcatttattacatacaatatatacttgtatttcaac

SEQ ID NO: 1764 - DNA, 392 bp, Homo sapiens
ggcttttaatcatggcattaaattatttcttatgtgtggtggtgtacgtaagtaaagggacccacaaaacactcgtgcaacccagttttaggggtgggagggtagggacaggaactcttctaggaagtattgacaatgcagctgaaagaaataacgacccccaaattctaatacgtctgaagcaagctctcctgagaattctggtgggctagggtcaggaaccttctcttaaggtacagaagaagtgtaggacgcttgggttctttgactaaaatgtttaggactttctttcccactcatctgtcccaaatgacttccttttgaataagaattactgtctctttctgtgagtgagtgacaggctatctcctgggtccccttttctctctctt

SEQ ID NO: 1765 - DNA, 516 bp, Homo sapiens
ctaagtgcagaagagctggtgctcctaggctggcagtaatgaaaatatttttaaaaggatgtctgctcctctatgtttccctcagtcttgactgccttcaaaggctgaggaaggtcacaagaaggctcctataactatagtatggtgttgtccaaaaaggaaaaaagaaaaaggtaagagctttaacaatctttcctctcttgctgctgttgccaagatgctgaacatcctgccacccatcctctaacaggtttttacaggagagtggcagactccgcccacttcatggtgaaggtcaggaagttaaagggtaaggcaacaagctgggggcgtgagggaaaaggagggaggaggatgttttgtggacagggccctggaagaaagcagagggtgtaaagaaagttacacggcaatttctgtgctatttagcaactatatattgagtctaggattgtaggggctgcagatacaaagatgattggatgactctgacagctgccacaccttaagtgactc

SEQ ID NO: 1766 - DNA, 171 bp, Homo sapiens
tctcagggatgagtcggagctgggactgggaaaggcagccctcttgtttctgttcaagttggccaggaatgcccaggaatgatgattctgttttgccagcttcttgccgtgaggctggggttgctgtgtttacagcacaaccaaccctaaagtcagtgcaattcactgtgg

SEQ ID NO: 1767 - DNA, 221 bp, Homo sapiens
ctgccttaaatgagggagggtgggcaaacagctcccacggtcggcggttgaaccagttcctattctttctcataggaagtgtccataaacattgtcttgtctcatttgcatggttgttgagaggtttgaatgtagtggtaatgaattgagagtgcttctaaaggtattaagctcttgatttatgtaaaactttcttcagtattactaggcaggctgataat

SEQ ID NO: 1768 - DNA, 1141 bp, Homo sapiens
cagtctgaacgtttggccaaacactggccactgtaaagatcttgtggaagtcagggagtagaggtggtctctctcccccaagtgaaggcagcagccaggacctaccgtcagagaccagcaaggagcagagaaaggtcaggctggtgcctcagaaagcatcagcatttctgcacaacttaattaaattactgaaaccttttctgagcttggagccatctttcttggagagtaatacaattgaaacagataatttaagccaaggaggaaggacagaattggtgagctcacatatgtagatggacatgtaatgacgtctgactaaaacacagaggaaaaaccttaaagtgaatcatgtttattcaatttccaaacaagtgcaaagacccaggcagcgtgcttcatgtttggactcttgaagaacacacatggaaaaaaaaaaagaaaaaaacctcttcccctctcaacccttttctaagtttttattaagaatatattaatttgagcattaatatgcaatgtatccatctttgtcagttattttccagaaaaatctagctcattttttgaggcaacttctagccaagttgtttcagttgtggagaattggggtcaagcgtacatgctgatcatggaaaaagcaatcttaaatgcacgcctgtaaagaggactctgagagttcatgtttctgaattcttgttttactccactccattctgtcaacagctttcttaacatgaggtgcctgtgacttaaagtgattatctgtttccttagcaattcaggggacttaaccatcatctagtgacctgtgtccccaaagcttgctgtggcttcagaggtctcctggaatgccccaaggcagtgtcactcaaagtatgctttagcatcacctgggccaccttagactttcaaaatcagccctcacatgtgcatgttcagctggctttctgctgcttctcaagccaagtccaagtcccaccccacctcaagggggtgcatagctgcaagcagcaggggaacaatcttcagaccttcccatctctttttataatgatgcctcctagtccatagtatatctaggataattttaacatttaaaatgaattatgttatataaaatggaataaatttcaactctacc

SEQ ID NO: 1769 - DNA, 3423 bp, Homo sapiens
ataataataattctgtgattatcctgaggtttcatgtttctggagtaggattatgaccacaacatttacagaatgaagtcctgcaggatgacaaaacatccctgtccccattgacacagccccaagtcacgggcttgcaaaagaatgtttgccatccctaggaagcctaacacagggcgctgggaaatgcttgcaaaagcagatattctcaggtcacatccttttagttttctgaggcccctgtgtttaaaggtacagcatgactgttctagggtggtcagaatctgtcacaggtgggagggaagtacttgtttagaatatggcagagaatccaccaaggtgttaataccaacaacagtttcttcttcattctgggctttttcctccccttatgcttgtttaatggttgggaaagagggctaaattgtacttttcctttgtaaaggtgcacatctcaaatttgtttcccctagtagcttgttttttaaaaagttttaagacatgacaaattatacttctttttggaagaaagattaggaaatacaggttaatggcaacccttccagagagcaccactgttcaccctgctattgccctgctgcttctctccctggtctaggatgtcagggacggcagagtggccaggtggaggggtcaggcttcagagggaggagctgcatttctgggagccaggctggccctcctgttgctctcagggctgacacttctctgtctcatccctcctccctcagtaaatgcagctggggaggattgcctagaaggggaaaactcatcgtgtaaggagaacacttccctcgtggcttttaaaatgtaatgcttccttccccttttctcttcttcccagagtaagagctgccagtaaaacttcagtgcaggactgttgagacgtatttgtcatgatgtgatggacaaaagaattgtcagctcctcctttctgtatcatctcattgatccccctttacccccttgcaaatgagaattacaggaaatcacaactagcattaaaaaaaaaaaacaaaacactgggcagatgggaaggatgaaatgtgtaacccccgttcccagaaacaggcagaatggctgagatgactgaccctagcatttggtgttcactgagccaaagcattgcctgaagataatgacaccgtctggaaatcaaaacctgagtcttcctgctctcatccaaaactcccctcttttgagcttctccaatctagtcagtgacccgccctcccagttctttctttcacaggttcctatctccaccaccctaaccagaccttgtcatccgctggccttccaggctgtttcaatctctcttgccaggttcaccctgctagaacacggttctcctctccggtgagactaggtaagagaaaaaagccctatgtgtatgaggtagcattcctatcccttcctatggtagaggtgttccttcaggatattcttggtcctcaaatataggaggcctttaggaaatgattgttgaactggattaggtcaggtttcctgctcaagaatatttgttgacttcccactacttactgatccaaggcagaatttctctgcctgtttttcatggctgtgcaaactggccttaccttaaatattcagttgaatactcaatactttgtggaatagccagagtctgctatgtgacagatgctaagaaaaccagcaagaactgtcccttgccctgacagatttcagaatggagtttattttctgttcttccctgatccttggcctctcttcccgaccttaccctgccacccgctatctagcatgtttgcttcggcattcctgccccagaaggaatgttccctctttacaccctcatacttattcagccctcaaagctttcaggtcagatctcctttctttcctttttaaggcgctctttgattatcttggttcagattaatttctttttttcctattttttcattattttgttcataactcacaaatagctgcagcttattcttccttatattctaatcattcatatctcactggttagcattttattgcacccatgtagaatactgaaatagacatgattgccttattgtgtgttttgattgtttgctgtttgggtttgcagcctcctcaactccactgaaattcttggtaggctggggattgtgccttctttgcattttaaagctgtatatagaagattgtcaggaaatgatgatacatggaataaacaaatgtgaaccattggaggtgaaaggcgacctgatagtactttgggagtgcagttcccagtaggattttgggtggcctggagcacagcagcagctggaggctggggaccatccagttttaggactctggtgaccaagacctgagagaaagtggaaaggtcaggaagggtcagacttgtctcccaagagtttgtattatcatgggattctcttgaaactctggttcatgtggaaaatgtgcttatcctagaagttgactagggttcttggggaatgatggtgaggccagatgcctctgtttgatccaggttctctgcatggtgaatcaccccagaaggagggtgtgaaaggtgcctggccacagggaagcttatagcttcagggaatgaactcttaggagcaatggtaagcagacctgtcagattgaggatttgatttatttgtattattggcacttgtattgatttttctggggagtttggggatttgaatgtattttgcaaatacaaacattttctttgtcatgtcactgatgtggtttataggcttatgttgcattttttctttgaatagtagaatcttgcatgaaattaaaagcagtatcctccacttctgacttggtagggctttaagcatcatgctaacttttcccctccatctccctttcatttcttagatccacctaggactgtgaaataggttggtaacatctgtgggctaggacggtttcagccagctaaattccctgttacacagtttagatttatgaggcacatctaaatttactggaattctaggtaggaagtgtggttgcaaaggcaaaactctttgtgattgtagcttgtatgaaaatagaagcagcttgaatttttttctcacaaactttatccaaaacatgtctttacatcttttatttctggtaaatggattttggggtggcatccccactactgttgggatgaagggatataacaagctagagggtgatttcacagaatcctgagcctttgaaaaatgctgttgcttttgaaaagtaataaatatagaagccaggccacctttttcagatttataccctcttcccattctattctcagctagtaaatactatggcctcagtttgcctaaaaagataatggcttaagtttatttaaatgtcagcagtagtttggtaatgaattaagtcctt

SEQ ID NO: 1770 - DNA, 494 bp, Homo sapiens
gaggacactcagtagcagtggactgagttgtggactagttctttctaaggctcccaggaagaaaattgctaactcacttaatatgtgaaggccttagtgtcaggtagaggaggaagcagctgtggagtgtaaagaaatcatctgcccaaaggtacactttagagaaagactttggatgaagttgtgtgttttctttttggaatagggtgtattgcttcttttgagaaggccttttacaatagtacaatagttcctctggaactcatagcaggattctttttccaccctcttctatatttacagctgcttttcccctaggggagcattcatctgttttaaaaagcagggagagaaaacaagttctgtcaaacagtgaggtttggaaatcagaactgtacttacttgcctttcaggaggacatattctaaagagttgttttttgggtggaagagaaggaagtcatctcctctgcccccactccacccaaggcacac

SEQ ID NO: 1771 - DNA, 1310 bp, Homo sapiens
ttttcacctccacccagaggttccttgtggcagatgtgaaggagtttagaacacagggttcccattataacccctttgttgtacgagaccaaacgtggcttttcagccctagagtaaatctttttctggcaggccactttcttggcctttatatccatgtctagggccctgggctggcattggccctgaaggccagggccagcctttggggattgcacttgagcatgtggtcagggacagcatctgagggcattttggacaggaaagatttctgattattaggctgttttcatcacacctatgcttcagggtcatagaactgaggattgccagggactgagatgaatttagtaagttggtttaaccccagtgcctcttattctctttctgcacagtttttagtcagctagtgggtgtggacatgcatctttgttttactatgagaagaggaggaattgtgccttagcagttgaataactgtgccttctatttagattctgtagagggttacactcaaagctaatgagtgctttcttccactctgcacacactcttgctgcctggagtgggcggcaggctatagaaccacaatagagcaagtactgttgctgttgaaggcatagacggaggtgacagtaagggcagctaggccctgaaattccagtggctcagacccctggctgatggcttacctcctgaggtgagaccaagaggaaggccttcagcttccctgaaatgagtgcttctcacagttaaggtagtgtgaccagccaggggtagggactggcttcctgaggaagagggtgggagagccttaattaagcctgcctggtttggcagtacctcagactcgcctcctctttctgtgttggctgataatttccttcagctcttagaacaactcttcatttcctgggggaacccattgttgccaatatacactcacagagcctatctccggtactgccatgtgtgctttctgcctcctttccagaagaggcaggtagccagtctttttttctcatgagctgttcctaccttgttggagttcctggaggctagtgctgctggacctccagtctggcagaggcctggacgagagctattccttgggttctcagaacagacctagcctagtggagaacagttctgggcctggctctgtgtccagaagggctcagtcagtggtcagattctgattgggagatatatgaggaaactttgtttggtgagagttaggagaatggggttctggttcagccattctctcaagaagtcatgatcatttgataggcctcagttttcctctc

SEQ ID NO: 1772 - DNA, 161 bp, Homo sapiens
gattccgtgacaaacccgggagtctgcccctggtctaggtgaccaaagttagcaaaggctgggacagcacagattgcagttcccaggtctcttttgcctcccagctttttgatgtgtttcttctccttggaatgccccaccactccctgtacccacctctt

SEQ ID NO: 1773 - DNA, 651 bp, Homo sapiens
gtccccccctaaccagggtcagcataccccagtgcgctctgggaactgttctctgaccctctccacccttaccctgcctaaggctctctctttctgagctgtgtgtgggtgctggagagccttggataatgctgagttgtttttgaagtgtgtctcattgtggcaaagcattgggtgatgttgccatccccacccccaggacactcttgcaagaattgcttccaccagggatgggcattgactttgacctggtcctcctcatctccagccctggaggaggggcaggcaagcacgtgcagattgctgtcctctgaccagctgcccagggctgggccatctgctgcttgtgacagcgggtggggtgagaggggtgagtgacctgtgcaggggagggagtgtggggcagcagcatagtcacttcagtgcactgactgcatgacagagtccagccccccttctccccacgttctatcttcttttccagtgctcagttatgctatgcttcatccaggtcttggttttgttccagctgctgccccccaccactctgctaggagaactcttgctgtgtttttgttaactctgtgtgtgtgctttgcccttttgcctatgcctccaagaatctttatgttacataagacagcagcagca

SEQ ID NO: 1774 - DNA, 302 bp, Homo sapiens
atgttagaaatgaaactttggacccttgttattctctgttcagatgcaaatgatgaatctctttccatcagagtttatacctttctgtttaccaccccgttttctgtccctcctcctggagagcctttgaatggcagggatgggctgaatcactcacttggaaggactgtaatttagcttgtgcttcaaaccttgcctctttctggccttgtaaggacctaagaaagacgcaaaaaggaagtaatctacccccatcactcttggtgtgagtttgaaggttctgaactggggtggggtgggga

SEQ ID NO: 1775 - DNA, 173 bp, Homo sapiens
gtgtgtgtgtgtgtgtgtgtgtgtgtgtgtgtgtaattgtgtgtgtgtgggattgaaggatgagggttgtggacagtcttaaaagccacctttaccaaatgaagaggtgacaaagcagggactggaagggcagcataccctaaccaggacttccccaaactttaacatgcata

SEQ ID NO: 1776 - DNA, 327 bp, Homo sapiens
ctgtgtccttcctattccaccttttaatagttgatttaaaagactgacctagggaaggcaagacaggggctagtcaggacttgcgtaatttaaacccaaggtcctgggctggcttctcagccagtgtctacagagccttttaggcgggcccctcttatctaagctgctggcttctctgagctcctttggtccagtttggtttccaaggtataagaaccacagcccttcagagggtgtgtgtgcttactcacaacaagattgggtccttgcccgtttctctttggatcattagaagtagataaggccaggccgggtgcagtggctcac

SEQ ID NO: 1777 - DNA, 165 bp, Homo sapiens
agggagtgtaaacctgagttagagatgagagaatcacggagttggtctggggacatgctggttggacaaaaaggctttccagtggtttgggggagttttgcaccacatgtacaactaaggtggatcaactgacatcttggcagcccatcctttgttcacttaggc

SEQ ID NO: 1778 - DNA, 53 bp, Homo sapiens
gttcaggcaactagtattttggggaagagagtccctctggggcacctacactg

SEQ ID NO: 1779 - DNA, 326 bp, Homo sapiens
gcggggggaagtgtgcattagtctcagattataaaggtagcatgggtaccagccttcctgggagtttatttacagtttagtttatagtttagtgggggagggaggaaccacgaaactattaactatagactcccgggaaagctcccaccttaatgcctcctccaggatgtgtagagacccaggctggactctgaagaatggggtcaaagcccagggtgcttaatgaggaagagattttgctgtcctgggctggattgcatagctaagaactgagtaactatcattcacttactccttaagagaattcttccattctgaaaaaaatt

SEQ ID NO: 1780 - DNA, 461 bp, Homo sapiens
gcatgagccactgcacctggtgtgaaaaataaattttatctgaatttgtagagggcagtgagacacattaaccaacaaatatctacacttgaagggagagagaccagctcaagcctgacattggtagactaactccttattttttatttctaacttgattttattctgatatgggatgaatcctctgatagcttttcctgtctcttttccagtgtgttaagtgattattgctgtaagactggaattacagtctgtaacgttctgaggacatagatataaaacatgggtaaatgccctttttagatgtgagcctaagaaagggtttttatcctttttcagtttcagaggatactgtacttgcaaatgcttttaaggccacagagttctcacccttgtactcaacactaggccttcctaaatattattccagtgcacaaaaagcattagtgatggaatggagc

SEQ ID NO: 1781 - DNA, 126 bp, Homo sapiens
tctgactctgagtgagttctaggggttgtgccacccacttctttctgatcattattttcccacccttgctagtttcctcagaggcatgcacagatcagtactcagcccaaaactcaaaggggtccc

SEQ ID NO: 1782 - DNA, 485 bp, Homo sapiens
tattcctcagctgtccctcaaatcaggtattaaccttggatgtcttttccttctgtgttcacttattgaaacatggatcatttagacaaatcttatggtaattcagccagattcacatcatgtcagtttgccaaatatttatctggcacctgctatgtccaaaagaatagtatagccagtatcttgctgaacgtggtataatctgtaactttacccatattctaatgctgcaccttctagcagaagattctgtgcatcctgacatgcatgtgacacaaatacactttgagtcttcttcctgtacctcctgatcatggtcccattaaacctgggcaaacaactgaactaactagtcagaattggtgagcaaacagcaggtgcttggctgtctgcctattcatgagtcaggcccagacagccgtgtgtggggagggaagagagcattaagtctctgtgtgtgggtgagcacctccattttacctggc

SEQ ID NO: 1783 - DNA, 421 bp, Homo sapiens
attgaccctgtaattttctctgtcacttccctcttctggactccagcttatcttcctgttttatctttgacacgttggctgtatatctcccatgacttttcactttgtacctcatgttgtaattatttgtgtttgtgtcttatatatatacacaatatacagtagaccgtaaactcttaagggcgtatgcttcctttacctctcaaggaatctcgtacatgtaggtgcccaatgtatgtgttgaatagtcactgagttccttaagaaagaagcatgttaggaatgagttcataagccctgtctggagggaaatatcaaattctctcattaatttatgatgtttcttcttcatcttctctgtgtttatcataatcccttttaacatattccagaatgttgcctgaattaattaattaattat

SEQ ID NO: 1784 - DNA, 1057 bp, Homo sapiens
ttaattatttctcaggacgtgtcctcatctgatttgcctggattttataaagttattcatttggtgcctttgtctgaactttgcctaatttggattacttttggaatctctatttggacgtttgaaggactctcctttatgttaattagtttaagcaaactccttgattcctgatttagggccccacatgcagggaactggaagtatgactggagctagaactagaacatatagaccttggcagagggactttgtacaattagaaggtgaggtaagggtataggtggcggcaggggcatggggctaatcaaagggaaggaacagtgggcaagttcctacttctcatttttgcttgtacctcacagtcccaccttgacagcttacaggaagcttgggtaatttatgatgaagaggacaggaggaatcatggtttggttataaattaggaggcttcctggaagttacacaagatggagaatatttggagccagaagacaggatcttgtttggcttgagtgtgcacctcattggggctgttaagcttcattagatggaggtgaagacatgtccctggaatcctaaacctgaaactcaggggaaaatactcaggttagtttctgactagaaaggagggaaatggcagaaactgggaccatatgtatggagaaccttaaggcctcagatgtattagggaaggtcacctctttggccctgccactaggctattttttttccattcatgaatcctatagaagaggtaacaatttcaggggaggggatgatggggtagagagactttgttgttgttgaacactaaggaagcaggaaactttaagctgtatccccaacttttacctagcttttgctaaacacagagtgtggaagtgttagttcagagagactttccatggaagaggtggagggtgtctctgagctatctggaccatttaggaagccttaactcaaatcattgggttaattgagaaggtataccttataagacacaaaccccctctagttatcatccagtctttcttctcccttctttttcactccc

SEQ ID NO: 1785 - DNA, 227 bp, Homo sapiens
tttttcagtcttcgtctttctgggcctttgctgtatctgccacttctcatgttttccttgagtctctctgtctctctcttgacatctgtgttgcacatgcccctggtttccatgtaccttttggagtatctctcataggctttccttcctcagtatgcccattataagttagcattctccctaggattctgtccttaactttcttctcaacctgtcctctttcctag

SEQ ID NO: 1786 - DNA, 43 bp, Homo sapiens
tagtttttgatatattctatagcatttggcacatcacaggcac

SEQ ID NO: 1787 - DNA, 590 bp, Homo sapiens
aatgtttgtttatttcatccaaatttaattacaattaagtaccttggccttggtgaagctgaatgctcctggttacactaacttttgggaaggtcatttgatttttggccacactgaaattatatcaggaagactcttttgaaagataaatactttgttggaaggattagtcattattagaaaggggtggattggtcactctgctatcttttagggctctctaaggaactgctgagaagtttgtttatacagttagaggtgaggtgggtgaagtcaaattgtgctggctggtggagtgggggtggggttgtccatggtgctcatgggagtacagatagtgtgttggtgaacttgccacaatgctacggatttaatgcaagaaataggcaaagcttttctgctgggggaagtaatatgccccatttcactcactaatggatgtcctaattgtatgctagtatttctaacataaaggctgaggatgtgtatttaaccgttttgccaagtttatctcccttttcttgctgtccaaccccctggaaaaaaaaaaaaggaaaaaaggagaaagtgacttaaagaatcaggatttg

SEQ ID NO: 1788 - DNA, 39 bp, Homo sapiens
tcaggatatcaggatttggaaccagagaagctcttcaag

SEQ ID NO: 1789 - DNA, 30 bp, Homo sapiens
tgacaataataatgatagatggtgatgaat

SEQ ID NO: 1790 - DNA, 37 bp, Homo sapiens
acattgaggtaaagagaatgctgaagtagctatcacg

SEQ ID NO: 1791 - DNA, 614 bp, Homo sapiens
cttgagctcagttgagcacctattttttgttttgacctgagaactcactttctctggtcatttttgtcttatttctcactatccttttaatttcagtaaaattgaatgaaatagagggaaggatggtttagagttggggtttttggtgagtttttaaagtttatttttaaataggcagctttcccagactgactgggaatgtagcagaaggcctgagaaccaggaagtgacacagacctgtttataccatcccactcccaggcctttggaaaacgatccacagagatggtaaaaagtaaacataactgcatcagccagctctctagggtttgctatttttgacctggaggaggtgtttcctgcatagctgtaagtactcggaataccaaaatttagctcctaaacattctttgagtgaaggtatatagacagacagacattttttgttaccagacagcagcattcagtgactgtaggcagacaaaattaagttttttttccctcctctctctgccatccttttggtgagttgttcttccatttctttatctttctttgtaagtagcactgtgcatgcaaaacactgtcctgggagctctaaatttgtgcatggg

SEQ ID NO: 1792 - DNA, 1011 bp, Homo sapiens
tgcagtatagtcattggagacacagagccctaagaagtcagctttagcaaatcggcttcccggactttatttgccaactgggtattgaagcctgttccactcagccctgatgggaaccaagcagagagatgtgatgacacatgagatatatctctagggtctaggaaccaattacagtcgcctctgccaagcatctgttttgctacctggccaaaatttcaggatttatataatcttttccctcttgttttatacatgctgttattttgccattttgtatttttctatacaaattatatcttgtgagtttatctttttttctcattcactcgagaagtattgttgagcacttgggggcagagaattggtggtctctgcaggagtttattacctgcggaaatgcagcatacaaaagttaaataactgtgagtggccttcggggagggatatgattgactgtcctattcctggtccaggcagggatgctgagggtttggaagagccttccatgcctttgggctgaactgagaaattctccccaaactaagatgggaactaagcttgaccttttatttggaaaacaaaagagcagggagccctattagggaagcaggaggaggaaagacttccaggcctcttgaattccatttatctgtaaaatggggctaattccacctatttaatgaggtaatgagtgtgtgtatgtgtatattcccttagtctgccagaaactaatattattttaggatagtcacaaacaatagctgtttaatttggaggggaggtagtgctaagtgctttaaaaaatttttagaatttgatgggaaagaatgtgggaggctcacttgtttaacctgttggctgttctcttgtctaaactaacattgtgttttgagcctagtctcaggcagtgtttccaaaccagctgaaacagtgccctttggggagtctagtgggggtcagtcacggcctgttagaacaggaaggggcttagccagcatgaatttgagc

SEQ ID NO: 1793 - DNA, 81 bp, Homo sapiens
gcgactgtacctagaccacccaattgccctagaccacccaattgatagtatctgccataatttttccatgatactggcctc

SEQ ID NO: 1794 - DNA, 159 bp, Homo sapiens
aggaacttacgacaggctttgttcctgctcacaggcactttgcctcctcccccctctttttctgtctggtcttatttgttctctcttgccttctctcttgcatcttttctccctttctccctgggcccctgtatctctgcagtgtgcagaggctgggtt

SEQ ID NO: 1795 - DNA, 1431 bp, Homo sapiens
aagatgtgttattttttgaaagcattttaggaacactgtgtacggatagtccatacaaatgtgctgatggattgattaaaccctaaagggaaagtggactgtcctgggtttgctgcaatgcagagggatatggatggtagggatccgtcttgggaagatgtaggggaatgtgctgctcagtcagaacaatgaggatagagttaatgttgcttccttccagtcagagcctgtgttgacttactttttagaggaaatacttttgggcccctcctattccctagaagacattccagttttcttacagctgaaaggtcctttggggatcatccaggttcacccctgagacagaaagactcactgacttgcctgaggccaaaccgcttttcagtggctaggacctaggctgtccctcctgtcctgtgatcaggtccctgctgcagtcatcctgctgttaggtgctagagacttgttaaagagaagacttaggtggggtggtagtgtgtctgctggctttcctgttgtctgaagttggggaaagcgtgttgcccagatgatgtgagcaattctgggggtggaagacaagggcgcagggaatatcaaagcaattcaaaaaaacctctgacactgtgtaatggcttaggtggcttaagaggaaagctgagggtaatgtttgtgatttggaggctgtgtgattttaacaggagtttgatgtttgccttttcaagtaggagctggagattaaaggaaatggataagttaatattctggcctgaaaggatgtcagagtccggtaaaatatgtggctgtcgaagcactcaagtgttagtggcaaaaaggaaaggggaagatatagaagttagtaggactggaagaatccattgatccacaatgggagaagatagaaggcatctataaataactgaattttggggggtaggaggcattaaggtccaataagtgtttagatatgttttgatactgtagcctggccatttcagggtgagtaggagtacagaggggagatgttgcagggaagaaagagaggttaaggaagggcctgggcagctttggctgtattagtcatttctcttacttatcacacccctctggggaactttggacttcaaagtgttaggacttgttatcattacaacctgaaatgtaattagcgggttaatttctgttcatgtttctggaactgttctttgtcctttctcatcatgtggcaggatcaaggttggtgaacatagttaattaaaggaataaactctgttgttctggactctcaccactactaccattatcctctgtctagattagtctgaggcaagaaaaggatttatgttggttttatcatcccagttccctctcttaactaatggacagaggagccatggtttaggaaaaaatttgttctaaaaattacatgta

SEQ ID NO: 1796 - DNA, 470 bp, Homo sapiens
aataaaaattacatgtaaacggagtctgactttacccacgcagcacctgggagccacgcttgactgaatcagacccctcttgcctttaggagaagtgtttgatagtgtttgatagtgtgagatgaccttgcaccttcagcaggactatggcattctcagcaggggtgggccccaggcacgtggactgaggagatctgggccctggctgtttcctggctggccctagctgctgctgctgttgcctcccaaggccagagccatttttgaaggtgactccagggcacctttaaacttattagcaggctcttgggttaacttggaagcatctgtggcaacaacaagcaagtaaaccatgtgaactttgggcttgtgttgcaggcccttaccagaagcccaccgtgcgtgtcatcatttctcagccctctgctgtcttggcttctggctaagacaataaacataagccccaggtg

SEQ ID NO: 1797 - DNA, 219 bp, Homo sapiens
gagctgtggcttgagggcagttttcttcctcattggaggaacttacggacaggaagtgagtgtccacgacatcacattcagtagggcagtcacccagctgttgatattctaggtttacagaggtgggagaggctgcccttttggggctgacggtcgagctgaggcctcctgctaccaccaggtgttggggcagcagcactagttcccaagaaataaaat

SEQ ID NO: 1798 - DNA, 337 bp, Homo sapiens
attctgtggccttagagcctttttcagatgtggaaacagaaggcagagagccttcatgaccagctccctggctggtggcggaggtgggactgagtcattgaggccctctcctctgtctcagctctaagttcagatgtgatattccttgtgaggatggccgagtgctagttttgaacttgatgcttagttctaggttcctcttcagtgataattttttttaattaggaggagtagtcactaacatgccaaaggaatactgaagtgaaatggattctttttgtttaaacaaagttttagcctcagtatttctctagggataatgaatacctagtgaaac

SEQ ID NO: 1799 - DNA, 476 bp, Homo sapiens
gcttggtgtactaaagccacaatccaaggacaagtcttgtttttttaaattctatattcaaggcagattatttcttaaaatgattagatttatactgtggccctttctccacagtagctgggttctcccattctgggcaatactttggagatttaggggttagctttcctctgttttatttctgaagcagtaacccttggcctagccttacatataaacaccccactgactaccttctatttatcttttctttgcaaagccctcatttccatcaccccgtctgttctgcacctgtcccgtcttaggcttcaggatggaattggttcctcgactcaggtagctgcttaagcagtaagggaggagccagctattcctgcaaagcaaaaccaaaaacaaacaaaaaacctaaaactgatcaggaactcatacatgtacatcttgtctgctccatttccataccggctcctccccacagt

SEQ ID NO: 1800 - DNA, 249 bp, Homo sapiens
ctctattcctggtagagggagcaattaggtttttgggatttgttttaatggcagtttgttgagagaggagacaagtggtctataggaaggccttgctacattaacttaacattttgtttgaatagataatacatgtacaaagtacaacactcaatatagtaaaagggaatatatgcagttaaaaattttttttctccttccccgttaaccactcagttcccctccctgaaggcgaccattagttaccaa

SEQ ID NO: 1801 - DNA, 99 bp, Homo sapiens
agttaccaatttcttatgctttattccaggtgagtttttccgtgcttataggggtgtgtgtgtgtgtctgtctttcaaaaatacatgcatatacccagg

SEQ ID NO: 1802 - DNA, 273 bp, Homo sapiens
cgccaaaaaactaaatttaagattctttaccatttggccggccccactgctcttcccttgcctgtcccctcacaccccaccaaaatcctctaaaatccctgccagtatgatcttcctaaatgagtttagtcttataatttccctgtttagaatccttgtaagggtaaagtttaaacccctctgcttagcccctgcctccagcctctgccaggagtaatgtgctcccatagtactctgatccacttgtatttggtgcttccttttttttttctt

SEQ ID NO: 1803 - DNA, 225 bp, Homo sapiens
tcacatcctttaggactcagcatcacctcctctaggcagtctttcctgactaccaccacttatgcacaaaacacctaagcactaccttatgtggcctcatttattcactgcttaaatattttttatacacgtgctgtgatgtggcacatgcaggtgtcattcttgatgatccactggttattgccttgaggggatgacaactgcccggtagggttacctggtgtg

SEQ ID NO: 1804 - DNA, 38 bp, Homo sapiens
actgtgcaggtcttattaatgattacaacagcagcagc

SEQ ID NO: 1805 - DNA, 341 bp, Homo sapiens
ataaatgggcacacattcgacacacagttttgtgtactgtttggtggtcactcacagactccatcccagacctctgcatgaaccatccctgttctacagttttaaaggctcaaactggagtctgggtgaaacctggggacagaagactgctatagtcacaattattagagggaaatgggtgaggaccagtggccagctctgttcatgaacctttgacaattctcacagagagtcttgctttggacagagacaacttacgttgctgttttcagttaccctctttaggaggggagagtaggcctgagtcatgcttcagacacagattaaaatcagatttggta

SEQ ID NO: 1806 - DNA, 1521 bp, Homo sapiens
tcagatctgggtagtatccctggcagagtcccaggggcatcctttattagggttatagatggcagactccctaatctatgcatataaagccttattaatggagaagggggtgtgtgtgtgtaacttaaaaaaaagaagtgtaatattatatggaatacctgttgtaaactaaaataactggcaaatgaaattaaataagttaactgaaatataataggcccacaccataatgtattgtaatgtatcgtcaacccatttacctccctaaaggcttatagaaaagaatctttaaagtcttgagctctgatacacacactctttctcactctctctctgtctctctactggttcctatttttctgaagtctttgtctgaactagagtgggtgggtggtagggctagttagcaattgcagcccattctccatgcctccccccgtctcatctttttcagggacagccaacataatgtggtcacaggtgtgttgggtgagccttgattaatgagattcacggctgtcgagtcaggtcctccggctcatcagcctttggcagtttagcaagcaggctggggccctcagctcccactgctgcattccttctctaggcggtgtattctctctttacgacacgtgttctctctctttttttccttttggttagttgaacttgttctgagtccaagtggcaaaggcaaagcctgacttgggtgtagcagctctgtgtcaatagccgtctctctgctggagcctccaggcaggcggtggggcagagctgggcagtttctgaaagccctgctgtgcctgactgccatccaggtgagacagagctcacctcctggcttctgcacgctgcaggccttgtttccccagggaggagttgaaaagccacttctgtgcttgcctctcctggcagcagggattcgaatagttgctagaattctctcaactttgtgtgtgattatggcttccttaccaaagtggctgcttttaactaacttatggctgaagttttcactttatgtccttgtttgtttgttacaggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccggtaagtcctgacctgccttctgtgtgtgggtgggaaaatatttaataccattgtttctctcgaagactaggacaggggactctcctcctggcaggcggtttcagggagagcagagggtggagggcttttgtggtaaatatagcagggagccagtccttctgaggtctaatgagtcacctggaggaggggcgtgtgggagcctgctggtggtaaccttgtcacccctctcccccagccataatcatcatcaggaggacagaggtgtaaggttcagagc

SEQ ID NO: 1807 - DNA, 106 bp, Homo sapiens
aaataagtatgtaatgattgttagctgtcttttgtttgttcgtctttctgcgctttttctcagaatgagtgggtagttgaagtattgtaatttagtgaaaataaga

SEQ ID NO: 1808 - DNA, 72 bp, Homo sapiens
taaggactttgtggttgaagatggtgagctggacgggccctagcaggggctagacatgccccattgagcctt

SEQ ID NO: 1809 - DNA, 700 bp, Homo sapiens
cattgaacctttttgagtttgtacagcccttgttgccttcaacagtgctccagagacccttctaggcagtctttgtgtgatcttctagacaaaatgtccttaaaggacatgtttgggtgtgtacggtaggcctctgggtggtgtgccacaacctacctctgtgtctacactccagaatcatcattgaactcaccaatactggtgttcctactggactttgttagaaacacatacatggcagtttccttgtccagtgcttcctggagagggatctcagaactagatcctggaaggggactttggtggggacagtaggggagtggtatattgtggctgtagagcctccatagtttagtgctacttctttcattctctatcagctcccaccacccacttatccaacataaacagataatggcacagtctcagctaatcttttttttcttttcttttctgaattgttggaagaaacaattacagatttttttgttcattgtagccttctccactaccaacatatagatgtgcctttccttccaccctattctgacacttaacccaagccttttccccctaggcatgaggagcccctggcacagcccagggggccatgatgattgggaccccacaatgtggccatcatggttatatgaggtttcaaaggaagagaagaccaggctataccaatgtgcaacaaaat

SEQ ID NO: 1810 - DNA, 1242 bp, Homo sapiens
ttttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtg

SEQ ID NO: 1811 - DNA, 33 bp, Homo sapiens
aaaaagaaaacaaaaacaccacacaaaaaaacc

SEQ ID NO: 1812 - DNA, 150 bp, Homo sapiens
gaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacaga

SEQ ID NO: 1813 - DNA, 200 bp, Homo sapiens
gaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagc

SEQ ID NO: 1814 - DNA, 67 bp, Homo sapiens
ttcatgactaaggaccactctataactctgaggtaaaaagagcaaacataatgaagttatttagagt

SEQ ID NO: 1815 - DNA, 275 bp, Homo sapiens
acttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtg

SEQ ID NO: 1816 - DNA, 1327 bp, Homo sapiens
ctcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcc

SEQ ID NO: 1817 - DNA, 96 bp, Homo sapiens
agagacagacagggagagagatggaggaagggcaggttggtgaagaagaacacagacaatattaagttcactatcttatgagtgtggttcatggca

SEQ ID NO: 1818 - DNA, 470 bp, Homo sapiens
tatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagt

SEQ ID NO: 1819 - DNA, 73 bp, Homo sapiens
ggataagcaaatgaattaatataattagttgcttatattttaccccccacactagcctatagctttaaagttg

SEQ ID NO: 1820 - DNA, 404 bp, Homo sapiens
tctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaac

SEQ ID NO: 1821 - DNA, 706 bp, Homo sapiens
gctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagac

SEQ ID NO: 1822 - DNA, 235 bp, Homo sapiens
aagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatctt

SEQ ID NO: 1823 - DNA, 1530 bp, Homo sapiens
gtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttc

SEQ ID NO: 1824 - DNA, 111 bp, Homo sapiens
tccatctaaaactttccagctgctctttgtgaagttcccagaataatgattaacattattaaaccagagactaaaaatcttggtacggactgacccatggggacacattgc

SEQ ID NO: 1825 - DNA, 747 bp, Homo sapiens
ggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacaca

SEQ ID NO: 1826 - DNA, 2751 bp, Homo sapiens
ctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcc

SEQ ID NO: 1827 - DNA, 481 bp, Homo sapiens
aaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaagg

SEQ ID NO: 1828 - DNA, 174 bp, Homo sapiens
gcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaa

SEQ ID NO: 1829 - DNA, 715 bp, Homo sapiens
tgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttg

SEQ ID NO: 1830 - DNA, 581 bp, Homo sapiens
ccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactac

SEQ ID NO: 1831 - DNA, 140 bp, Homo sapiens
gtgagccaccgtgcctggccaaactaagttatttctattaatgatcttatagtaggagaaatacatcactttctcctctcaaatgatgtgtgcctttgatcccccaggacactattatcatctgcaatcttaaacatgga

SEQ ID NO: 1832 - DNA, 1315 bp, Homo sapiens
caccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgt

SEQ ID NO: 1833 - DNA, 3436 bp, Homo sapiens
caggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaac

SEQ ID NO: 1834 - DNA, 812 bp, Homo sapiens
cccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtata

SEQ ID NO: 1835 - DNA, 1002 bp, Homo sapiens
catggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttt

SEQ ID NO: 1836 - DNA, 294 bp, Homo sapiens
tgctcctaggacagtattttagacctttccaagctcaagagaattactccatactttggcaaaaacacaggctgactaaatcagaatcttaagagtggcctgggaatctgtgctttgagaagaataccaggtaattcctgtgagttcaggtccaggaaagcctgctttgtgggatctttctgtgggactgggcccaggtaaccctcctctctccccacagtgaacttgtacttgtaaaacccagctgcattgattgtcatagacaacctggcagaggaaaaaaaagcgagatgt

SEQ ID NO: 1837 - DNA, 530 bp, Homo sapiens
gcgagatgtgtgtgaagtttgttcacggagttcattggaggcagagggttttgttctgtgattatgatgaaagaggaagttgggtgagaatggaggaaaagatcagagtaatggctgtgagctttttagcgctaattgacagggcctccttcatcttgacttgtctgaatttactgccaagtgcctaacatggaagggagggagctgtgggactgaagggcatccctgtgggcaagtaagtgtatctcatgcccagaaagaggaagaacaaggtttttgtgccactccttattatccaccgggctggctccaagagatgaactaaagaactggagggtttttgttgtttttgttttaatttctgcagctccacacccatgctgtgacaggaaccctattagtttgtactgggcttgttttagggttgttacatttagaggatgtttaaagtgttattttatataataagacgtggcatgagtgcacacacacatacgcatataacaaacccaagctgcatattttggcgt

SEQ ID NO: 1838 - DNA, 73 bp, Homo sapiens
gggcgtgggtatggcaggtggggtggggagagagaactgcaaatgaatcttaactaaaacatttttaagcagg

SEQ ID NO: 1839 - DNA, 264 bp, Homo sapiens
gcaaatatcctctctctctatctatatgttgaataaatgaatgctattcatgatatatttgggaaaggacagggatgatggaattaccagagattttttattgtctccattattcttttatgtgttttcaaatactccaccataaatttaataatgggattttttagtttgaaaagttacaaagtagtagtatgtaccatcccatagggaaaagattggaaggatacacacacacacacacacacacacacacacacacacaca

SEQ ID NO: 1840 - DNA, 123 bp, Homo sapiens
gagggttatctgtgtggggtgctgtgggtgattcttttattttttttctttattagtgttttaccctgcagctccagctcaaaggatgtatataatactaataatttgcaacaagaaatgaag

SEQ ID NO: 1841 - DNA, 350 bp, Homo sapiens
agaagttaccttttaaaaaagcattgaaattaaaacataaattaagaaataagatacaaggtgcttgaacatggtaagtatcaaacaaatgttaaaaaaaatttactaaggctatgtcatgacaaaagcagaattcaaaaaagtatatataagcggtacaataattaactttttggaaaaaatctccacccttgtgttgagggtagtgctccaaaatgatattgtagttgtgtctgagtgtatttattactttaaaagaggaaactgtatggtagatataatgttttataagcttgcattttgaacatctttcacacattgaattgtctttcataaaagagctagaataa

SEQ ID NO: 1842 - DNA, 251 bp, Homo sapiens
gagctagaataagctagaataaggggaccaccactgaagcacttgggagcattttcaacctacgcagaggggtggtcaccctgtactacttctcttttaatttcattactcagataattgcactgggcagcatcttctagggaggcaattttctggccaaataattaaaagaagtaagagccatttagtactttccctagaaagttatcttttgggagatgggagaggcccttgattatttttaaagagga

SEQ ID NO: 1843 - DNA, 178 bp, Homo sapiens
tcttaaagagccatagactatctcttaagaatatacaagaaactggtaacaggggtttcttctaagggagggggacttggggacttagggaatatgattgggaggaaaacttgtttttttctgtatacattttcatgctgttcaaattaaaataatgatgtgcatttagtatatgttc

SEQ ID NO: 1844 - DNA, 185 bp, Homo sapiens
gtctgttgcttatggaacaactgtgaaaataactagatcggaggaaagtaaaatgtgttttcttatgaaaatatgcttgccattaaactgattagtttccatcacagatagatttgtaagtgactcaaaccaagactttccaacatttgtctgccccacctacatgtctgtgcttctgtctactc

SEQ ID NO: 1845 - DNA, 183 bp, Homo sapiens
accattactggggagttacttttgtttctctaacagcagggatggatttgggctaaccccttccactggttcttcagggctccttgtacccagggaagtggctggatggaatgtgagtaaccatcactgcccaccaacaccgggaagtgaaaactggacccaaaggacccacaatcttcacct

SEQ ID NO: 1846 - DNA, 567 bp, Homo sapiens
acatcatgtctctctcagtaagtaacaggttccggtgaggcagaaacaatctaactgattggatgcctcaaatctgtacagaagccagagagcccacctatcgtaggaatgtatttgagagggtgaactattctgaaacattccatctttatattgacatccacataaccactctgcagctaaaggtatatccaagcacccagcttcccatgccagaagcaaggagcctgttccatttccattttcactctccaccatgtctactcgactttagaaatagctctcaaattttgccacccattttctccacctttgctgacaatgacatataatcagaccctcagaatctattgccacttctagctagtcccttgcgacttttcctcccattatcttcctctccagcatgctttcaaaagcacaaatctgaccatttcattccacaacaggtcacaacttcctttgggctgcaccaacacaccaggtcctttgtcatctcctttcagtctcctttccagttttcctggctgctcccacagaactttatttctacccagatcagagact

SEQ ID NO: 1847 - DNA, 37 bp, Homo sapiens
aacagaccttttgagtgatgtaacatggccatcagtg

SEQ ID NO: 1848 - DNA, 541 bp, Homo sapiens
ccacactttgagtagtgaggacctatagaacattaataacttttttagatggaggagcatgttgaatcaattattcctctaaggatcttgaagttttgagtgaacttttgatttcaaaaagatcaaaagaagtaaaagattttataaacacacacaaacacacagttatacagagtaagctacagagctataggttattccagaagtaagtaggaaaagggagtaaaaataagagtcatctacccttaaattctcaataccattattctaatttgccacttgaatttatattagaatcaccggggaaactttttaagcagcacatattctccccccttctctccctccaatctgatttgctcttctagaggaataggacaccctcagtccatggctccctaccactgaaaaccacagctttggagaatgcttttgtaattgatggcaatgttttgtgtcactcagctgtgctgggaaagaaacaagcttttagcttcatagtaattctgatctaagagctcttctacaaaaggagtttagc

SEQ ID NO: 1849 - DNA, 27 bp, Homo sapiens
acaccttaaactcctccttcctggaaa

SEQ ID NO: 1850 - DNA, 410 bp, Homo sapiens
aatgagtgaaaaaattaactcttttttccatatttaatgaaattccctcttttacttattttatcctcccgtccaaaaatggctgaatgtaattcctatgagagctgatatttagtatggggctagaacctgcttaaatgacaatagagtatgtcttgaggtttgtttggtctgaattgcttgggttgaggaatcagacaaaaacaatgtttctacctcctcaatgttaaaaataaataataatcactgcctaccaaacaatatgtatcatatatgtaagatatgaagcacaaaaacaaaatgaacatctatgagtccaccactcaataaaagaactagaacattagttgccttgtgaagctacagggtgttcttgcctcttatctccctgccttcccctatcctctaaa

SEQ ID NO: 1851 - DNA, 232 bp, Homo sapiens
tcttactagaacacaagcaatggaatctcaagctgcagcactttggggccagaaggcagagctcctgcctggataggttatttcctcctgaccacctgacaagggactggccccctgaggcttacactttgttgagacctgaaactgcagacagagcactaaacttagaagagactagggccccaactaagcttccccatggatagatacatagtcatcatagaaggcaatc

SEQ ID NO: 1852 - DNA, 152 bp, Homo sapiens
ctacagaaatcttcctctggggcactttattcttaatccagagagggttttcttttttttttttttgtaactgaagatggtgtaatacgatccattacattaataatgactgtaaatattcaaataactgactagtttatttaattaattaa

SEQ ID NO: 1853 - DNA, 2304 bp, Homo sapiens
gaccagtttatttaaaaaaaaaacttgtttaacttaagtggcatgaatttgataactttcatttctttggttataaagacgggtgatattattcgatgggataaagaaaccaaaattatagtttcaatatgcaaatttaactctcctaagagacactggtctcctgggggataaacagtccccaattatctgattgatcattcttgtccttggatcattccccatacccaccaggcaaatactaggtgcctccttaaaaagccatttttgtaaggaaaactttaaattcattaaatttaaaatcatcttccccttaggagcactcataattaggctatactaagactctgggaacgatctatggagatatggcaaactagcctccgtgacttgacggtttctaatccacatgcgaatgtggaaaaatgccaaaaagagaccaatcttcagcagaggtacttagcgctctccagagtatgcataataaccgagtgtggtatataagtctagggcagaggcatctgtctccatccatcagacagtaaatgtggagctggggaggaaaaggagtgcttcctaacaggatgggtgttggtgtgaacaaagggggcttttgaagcctgtagtggaaattttccttctggagctgtgtccttcaggaattctcttcctccctatcccttcccatctgcctggtcctctctacaccaagtcctcttttaccatttaaacaaatcttttggtttaacaacgtctgcaggcagatgctaaaagctttctgtgaggcagcccttttttaatgtcaggatgaaactcaggagctgtttattactctggggtggggggcttggagggaaagaacaccaagtaattttgtgcaggaatgctgaccaaacagtactgaggtacttctggttccagttttcctcctagcagtcattttaatcagcacttcccccttttaatgagctggtagtgccattacataatcacccagctcactggattaatgatgaaaagaggaactgatttttccagttgcatcatttgaagtaaatgttaactttctttctgagtccttagttaaccgcattagtgtgacaaatatgtctttgtctagcataagtaattagaatttaatcactttaactgcatcttaattaccccaaatgaattgaaaggacatttaatagcaaagattaaattgccttaatgaacgatttttgtgactccatcaatactcgaatcgctttagccactcctctcacgcacttcagtcgcagaatctgcagcgagcacagaggtcactaggtggcgcgcttcgctcgtttgtttatttaattttccccattgatctgttttagaagacaacaggaaagaaagcaaaaagcacatagtttattgcgttccttcgataacctctctttgggactatgagatcatcaccagatgtgaaaacgaaagcagtgatttcagaaaccgtcgattctgaatatcccgtggcggcatatgcaaaggaagatgagaaacacatggtgactggaaacatgcagtgtttgacagaaattgcaagatgccctctagacaactcccagcctatatactctgttttggtcaatttattactttttagtgcagagccctaaaatttgagttacaggcaatctttgaaatagcaaggcaggcactgatgtggagccaagaagtgtaattgctgtccaagtgcagatcagaatgccaatgcctgaaggtatgggaagatctgagcccttgggcccccctcaaggcaagggaccgaatggaccagccccacccacaggcacatctaatgagataggtcttgtccatcaataattgtttaagtgaacaaagggatgggaggctggggtttcacatctacttctggcacttcctcacattttctggctgcttcttcaaaaaagagtaataaaaaatctcttttacaagtcttgagtataaaagaaataagttttcataagtgactctttttgagagtcccaaaggaaagacacactttctctaatttcaagagcttattatgtagagacttttgaatcagttatttccacattctgactccactaacctggtgcacctgtcctggcaacagaagcatgggatggaggataaaatgttctgggctttggactgggaaagctgagctcagggcatcactgttttccagtggtgttatcacaagtaaattatttaacctcactgaagagagcaacagggaaaaaagtggtaaataccacttagactaatggttcccaaacttggctg

SEQ ID NO: 1854 - DNA, 190 bp, Homo sapiens
gtataaatgttgagtcttcaatgagaacatctatgttccgatcacagtacccaacaaatagaatgtgcacaaaaaacttaagcttcttccttatcagttactatgacaaatgagattggttgtactttagggtctagttctgtccagctgttgtcttattaaattgcctcatctaaaagagaagaaaatt

SEQ ID NO: 1855 - DNA, 5438 bp, Homo sapiens
aagaaaagaaaatttctagaaattaatttgttacaattttatgataccgtaacatctcttggaagagacatatgtggatgcttctatagcaagaccctgtgataagtaatttttatgtttgtatcaaaataatcagattgtcttgtgattggtctagtcacctagcccaatcttattatctcaggaggaaattaaacttcgttagtattaacatacttgtattaaaataagaacctatacaaacctattgatagaaggtaggaatttatgattgtgcactaaatccattcacataagaaatatttttctttttactggactctatgagactgacattttttatgtagaaataatgtggctttcttctcccaaagatgcttatccatcttattcaaatagagacacaatgagagtattatttaataaatatttgttaaatgttttctccagcattataagaaatgcaccctctaacaaccacaacttcagtaacaccttccttctgttgctaccctaggttgggggccattcaattttaccaagagtgtggaaattctgctgttttaatggggactgaaaggaaactagtcatttctcattcaaaccatcaaggctcctagattgatttaaaatattaagtcggtgtttaaatattccaataaatggactttacaaagagcacaagcaatgtcacttgaggaacaaggcctcaagctgaggagcaggatattggagagcctccttcttaattacccacctttattagacttgaggattttctgtcttacaagaaaatcagaaataaattttattggtatgctctgtaagaacgatttcttctgataacttggggtagcagcatttgtttgattagctgaatttgccatgaatgtggaaataatgacatcaaaacagctcgtgtaacaacctccttaaagacctcgtagattagagatgactatagattttccccagcgcggatcaaagggactgaattgaacgttttagcttaatgatccaacccctgtcacacccacagggacgcgaattccgattttataagcaggtgtgcacgtgcactcagatactcacacaaagccgcgtggagggacgaaaagatcaaccacccgatcgacgaggataggtttgatcttttcgattacctcagtgtgccagtgtatattcccggctgggcctagcgccctaagaaacttcggaactttagctgttaatttttgttttcttactatgacttcccaaagacattctatctgcctaccggggcgaagagaaatgggaccaggcgtcagggcggtgggaccctgtccagggtcctgactccgcgccagggctccagaccagtcggcctccgaaggccctttcacccaccccacacaagaggaaacaaagacttctcagctcaaggcctcagggctgcctcctgactccggtcagtttgcaggaagaggaaacaacaaaacaaaggaaccgccaatccgccgggtattatatccctcagctccaacctccgacttcggaccgccagggtcaccttctctacgctgaccccgcttttcttaaatgaaaacacgccaacaaaagcatacttcggatacaaaatccaagtacgcatcttttttggggaggttagagctgaggtgtacttcggaagatgagaattttgttttcatgaattgggtaacacccaggcattgttaggtaccccgacagaccctctagatatccttctcttcctccttcacactttcttcctatcaaaatagttattgttttgaaattcactagaacaacgacgttctaaaaacaaaggcgcagcaagcatccctttcttcgctgccgcgggctgaaccacggacgctcgcgggtcgcccagccccgacggcccgcagggggcgcgcgccgcagccgcagcacagcccggctacccccagaaagggagccgaatggagggaagcagggagcgcggagggctcgaggcttgcagataaggagaggcgcatcctgggatttgggtcctctgctgctacaacacaaccgtgctattgttggcactgtccgacccaagtgtcggtggtaagcggcgatgtcggggctgggtctctagcaaccgctgtgccctgggtcaggctggtcgccccagctaccgggatccctctccggatgcttccagggcgataggtgctgcacccattgacgggatagccgcatacctccgaacaggtagtggagttcgtctctggcaggcatcctagctgcgctgacaccaaggtcgccacacaatagccatcagccccccttaagccccagaagtaggtttcccctgccccagccatagcggttccagtcgtcgccacgagcccacttcttatccccaagcgcacctccctctcctcacccgggtttatgcccgttacacagagagaactacacagggggaactatggtcctacaccctcgaggggacagacaccggccgtgagacaggcaccacgcagagccttctggtgactgtccgcaggagcgagaccttttttggttttgcagtcggctaggtgtgtgtgtgtgagggtccccagttgactaccgggatgcactgccacttttcggcctggcgggctctgggactccttggtctccgtaggaggccatcctaggccttcggaggaggcgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatggccgccccccgaccgaacccctccccccttggctcaggtccttcttaggtcgttctggggcaaacaccggacgggaagggggcgccgccaactcccccgcggggtttggaggtttcctcgcctccaagtcccgcagggcagggtcggagtgcccaacacccacccccgcccgaacctcgggcctgcgcgccgccttcccctgggtccgcggtgctgcgcttgctgttgggtgtgtgtcgctgtctctttccgagccggcagctcctgctgtgtggccgaagccctctggaatctttaattggaaactaatcttggtcttgatagacgcccacgtcagaggcgcgccacccacccacaccccccgcctcatcccggaggagacgcggcgagaaccctgtcgctctgctctttaatggggcagcagcaagtagtacatggagggaacatatattgatttttaaaaggtagttaatttggtgggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggagggtctctgagcgcaacagcaaggaaagctgccaggggcacctccccatatgggagctggtagtggggggcaggcactaatgtcccgtaggaacggccaaggcgctctgcaatccattttaaggctcatgcacttggcccgttagagatcatttggaaagttcagaaaataaccccactctttttaaaatatgaaaatgttaatgagatggctccttcttcagtaacttaaaaataggttgtgaagagactgttcctggttccttgcaggagaccctcctggaccaacacagaatcctcagtcctagccctttccaccatcccttttaagttaaggaaacaaaaatgtaatagacatgcttcctcagggtctcaggacacagagtcggcttggtgtttggtgccaaatgcctgccctgctggactctccagtgtttcactttttcgaggaaaaggccatgggcctagggccgagggctgcatggacctctacaggttgctgggtgcccaggcaggcgctccttcgatagcctcctgggtgccacaagcacctgccaggcaccatgtttgcgcctccagcgtgcgggtcccagcactcaggctccctccccctccacagtgccgtcccctgagctcggctatgtagctctccacgcttggaggtcagagggcgctcctgcggccaggtttccatggctcagaggtcgtctctgaacagaacgtgtcagtctgtccttccagggggcgacagcaggcagtggggggaggagggatattgaagtccagagcaagagcctccagggggcgggggtgggggatggggaccgagttttcccggaggggtagccttctccatttctatcttcttcccacattcccccgctccactctttggcttcagcgggcactgcctgggtaagaggccctgaagcctggctctggggtggtgtgggtgtgtgaaaaggcactaccttgggctctggagagacggagcagtcaggacgaggagcagccccttcgcccactccctccggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccccggctcagagcggattgactgtctctcgttctccagggacgaattaatggagaacgatcagttaattaacaaaccctcattccggcttttaccttttctcttcgccaaggctcaggcctgggcgctgggctgagat

SEQ ID NO: 1856 - DNA, 1810 bp, Homo sapiens
catggaccaggagtcaatcaacttggcaaccgccggccggatctcatcaaacccaggccaccctccgctgtccttagctctacctcccctcatgttctctaccctcaagggtcgccgaatcctcctgaaatccccggtggggttcgggctgggctcagctttcttctctgcctatccgcggtctcggggagccaggcgcggtgtctgcgctgcgccaaggagagcttccagctgaactcagaaacacctggggcttggggtttcgggcaggagacctctgctcctagacttgggggtcatttacacactctcatccccaaacccccctcccgcacggggattcagacgaaaatcgcgaagaggaataataaaacaaaatgcaaagtcctcagggagtcggcagcggagtcggtcccaggacatggctattgctttgcagctctcactgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtcagaggtacctgcgaggaacatttgcgtgcgattccacgcacgcgttgcatccctcttcccaaacccggatcgctgaactgagaggtggcgcagagtgtctcaccaggtgcggggatttctctccgcctcaggccgtacgagcttccctcgctgtccctgagcgcaaatgagcctcttcagtcgccgaggcccggccgcttagctctcggagccttccacagcccaacaccctgagccctggagtaggcaatttgctcccacagccctgtgctggcccttccaggcacagggagtcccccttctaggggtaggggcgggcgggatgaagcgcacccagccctctctcctacccttcctcctttggtcccttcggctttcgtgtaccttatctcccgcgcgcccagctccttggccggctcacctgctaagcggagcgcggacatgcgctggaactccggctcctgcagccacttccacatcctccggaaggtctcccggccggatttgagtttgctccagggtttggggttgcgcagcaggtccgagagggtcccctgggagcggcagagcaccctctgcgcgaagatggcctgtgggatgctgtagcgcttgagctcggtggtgatacgctgcgccacctctttggtattgatctcttccatctgccctgaattacttccattgctgacctgcgcgccggtcaccgaagggttgggctcccgggctgtgcccaggagttgcccgtggccctgggcgttcaggtgggcgtggggatggtgcggaggaaggccgttgatgggcaccatgccggccgaggtgggcgtgaggtgctgctccccgtggcggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgc

SEQ ID NO: 1857 - DNA, 496 bp, Homo sapiens
gggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggcaccggctcatggctcaccccgtgcagctcgccgatcgcttccatggtcagctgcgcgttcatcgtgatccgggcgagcaggcggcggacacaacatcgatgtggccaggcagaggcggcgaggggcgcacggagtccggtcttcacatcggctgctggcgactgttgccttccttcctctcactgtgggg

SEQ ID NO: 1858 - DNA, 45 bp, Homo sapiens
ctcgccttccctcttaccccccaccttcccctctgcgtcctcggc

SEQ ID NO: 1859 - DNA, 208 bp, Homo sapiens
ccaaagaggatccgcgccgttgggagagcgcagtgccccagcccgcccgcctcggccacctctcgcccctctctttcttaaaattctgaggtctccggctcccctgccgcggcccgcgcgcctgccgcgtctgctgcctgcccgccccgctggccagcttgagccatggctctgttactgttacagactctgtggccgcggttcggta

SEQ ID NO: 1860 - DNA, 2720 bp, Homo sapiens
agcggcccgccctcacgcccgccaggcgcagcgcgcatgcgcgaggcccgcccccgccccctaggtcgcggcgcgccaggcccttggcgtcccggtacaaatgaaggagggggcccagcgccttccctgcggcgctggatggccagggagctgcgggcacgtgcgaaagattggcgcagagcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattcacggcctattgggggatgggggttggggtggggtggggtgcagattgcttaaagggctgggtccgtttggcggccgttgacccggcacccttcgtcctcccagatacatacttgcccaccctttctcatccatgccctggggagaggagtaatcagtgccaagaatcccagttcgggccatacctcactgtcccccgccgcctggctccttctcccgctcagctcataattaaggctgtgcgtccgcttcgccgatgactcggcctgtggaggggggcgagggagagcggagggagtgccctggagggtacccatgttaacttccgggtgctggtggggccgtggaggctcgggccgtccctgcggttactcccaaggccctcctgctaaagcacccggaggcggttgctttccagaagtactgacgcagacagggtggacgccggcgcgcgggtctccgcttggcccctagggacgcccttttcccggcgtccccgagagacgcctccagatttgaaaatcaattcagcttcgggagtaatttcgcccttcccacagtcacgctccaatctggaatcgaacctggtctttgggcctggtggggacgtgtgcggaggcccccagtttgagacgtacacccggccgccacatgccgcggctttctttcatttacaaaagaaagaaaaaaaatccgcaacaaaaggcagagccgtgtccgcttaggtgctttcatccctcagagaaaggacagatgtgcccattgtccagcccgtggcagttatggccgggtcagcgccgagcctcagccccaggcaagcggtggttacaatgagaatagcctctcagagccggggtatctggactcagatatggaataaagtgtgtgtagcctgtgctgggccagactcagactgtaggtttgcttgctggggcaccgaactgcagcccacccgtggtgtttccactgcaaatgctcccaagcccttagagaggccaaggctgtggtagtggtggtagttgggtttccaaggcaaaagtttgggctggccaaccctttgggaaaagttcccaccggcccaggcatgagtaggcctatctctttgcccaggtccctgctaccaccagggcaacatcctaatccaggtaggtcaagttcagtggatacagtcaacgtgacttccttgaaggcggccatgtcctgggactggttaatctagctggttttatcaccagaggcactcccatcctgtccaaacaatgcatatggaggccctgcaaataattcatctcaatggatttcatgtctactttcataatgaacagttaggaatttaggaacccccagagaagaaaagatattttagggaaaatacactgatgtaaaggaactcagaaaacacgattaactctttaaacttgtatctatatctacctattcatacacgcatacacacaagcacaaaacatatatttcctgcctagtatattacagtaccttggtggaaagctgcatctttggtttttaattgtttccattctcatttcctacagcatgagaccaaacaatgggttaaagtagcagggagtctttcagctaaacagttgtccccccgcccccgccccaatattttaatcccgctgaagtgattgatttgcccttatgacaactatcttcccaaaaggcagtttgttaaaagaaagaaagaagtaaataccaccaagtgcacaaattgttcatggttttctctttgtgtagctaattaggaacttgatcttggaaaccctccttcatgagaggcactcagctgagcctctggagtccacctgaataaggctggcatcaggtgagctcaacttcccctctcccccaagggcatttatgaaaaggggggctggctctgtgttggtccctaaagaaggagccaacgaaaagacctggagaagcaccatatgtgttggcttgctcagtaatttttgatttttttctaaaacattaaaatattgtatgtgcaggatttgctttggtttgcaaatctccctaatctttcttggctattcacaccatttatctaaccattgttctcccgtaattgactgagttgcagtggtttctcagtcagaaacaacatattactgtgttcttatttgacctctcaaaatttttcttcttactaaggaagtgacgggtaggaagaatgctcttcttaggcctagttaaggtgaatttgcatgtgtggagggaggacgggcactagag

SEQ ID NO: 1861 - DNA, 1090 bp, Homo sapiens
gagtccacagaggagtccctggaaacttggtaggtgtaggtcaatgtgtgtgattgaggaggaggacttatttttagctgcttagattttgagtagctgcaggaaatttaaagaaaaaaatagtgtcaatcactagcagaaaattacataatgtatatatgtaagaaaaaaggaaataagactatgactggatgcttgttgctgacaatattttcagagtgaaaacaaggaacttaggatgtttattttgtaaatgtcaggagaagaacctgggatatgagatggacaggggcaatccttcttttgctaggtaggctagagcttaccacgctgccctaccaggttcagcaaagaaaaagcgcaaagagaataaaaccattcctccaaatactggccacatgagcttctctgaaaaccttccattggtttcagaattaatgctttaattatttttgtgagtagtagaggcgtaacgtatggcccagtcccagttctcaggaccattccaaagaaatgtttctagctcctccgaaccatgaaatgtctacttcccattttttggactcacaaagagcgagatcctgggtgtcagggcaaattcctccacccagggatccagggggaggctggctccttggctagagccccagggcatattcactggcatttctgatgcctgtagctagtctaacattaaacttgtggggaggaaccatttctttggtatctggctacagtagagcactagatagctggagagtgaaagacttggtcctgggtgcttcctggcaagctctcctgttccacttctagagaaattttattcagaaaattgctgcaggcttagagtagaacaccaagaaattcagaatggggtggcctggtgactcactattgaaaaccattaaaaaaaaatcactcaatgacttctctccactctctggggaccaaggaagtggtaactaattatggtagccccttgcttcaatctttgatactctgtttagcgtatcattttattcatatgttcggtaacatttttctttctcaaattacagtttttgcccaagaaaatatttttaaattgggc

SEQ ID NO: 1862 - DNA, 2402 bp, Homo sapiens
gcagtttcctctgttttatctacttcttgcccttccatatcccaaagagaagatgctctgtcaaagggctgtcagctggtgccatccgcaactaactccacgttctgggagttgccgagggctgcctgggcggccatcccaggacaccagaccactcggctcgtatctctggttacttcctgcgctggggaaaaaagaacacgcttgctctcctgggtcctcgggtaaactacaggcggcttctcctgggttggaatccgttttggcggtcgcctaattccgcgagggctttttcacggcttcaagccaagagcgctgaagggaggaaaggtatactgatgccgtagggctgagggagggattccaggctcctggggtgttcttctgcagcaggacccctcgctggccgctgccagcccacttccggaggagttggcctcgtctagccaacagttcagtgggatttctttcttggacataacttcatatcattgaaatagtctacaaaagacaccagctcaagccgcgagggcgttgaattgtccggatttggggtggcggttaatgctcctcttctggtgcctcccccgctggggccctgcattccattagccccgcgctggggtagagatgccaagtttaggggctggagaggacaaggggaaggacgagagaactcttgcaccgacggatgtagttccaagcgacccgaaatgaggaaaacccagaaggggcggacggagggcaaagtcggcccaggacgatcttcaggcgcaccattctctcgccctggagggacagggaagggcggaagcggagggtggctgtccagccgggagcctctgatccacggggcttggaccagccaccccacccgagggcggctgaggactgggcggccgagctcgcggcccacttagctaatgccgggtaatgccgaccccggcccaagagcagcagctgcacttgggaaggaaaactctttaaacaaatcattttggtgtctaatcaattagtgtttgcgcagtcaagtaccgtagatttaacagaataatcgttactgcccttgtctttatttgacccgcagacacctagaagatttaaaaatgaaacgccggtgttccgggctccccacccgttgccttcgactccctccggggcctgctaggccaggtcggggcttttgctttctccaggcctaatctcctctttgcctccctcttcaaccctccttccccttcacacttttccacactttaccttgttttcttgcccttccagccctgtcggccttccgagtctcgatctcctcatccccccgttctttacccccgtggctggcacgagaaacggcttctgattgtgggacacccaggattctgggcgagcgcacctgccttttggcctgagagccatctgggtgtagaattagggactcgccaagcgcccagttgtcttttccctggaccctcactctcttaccccttcctgaaccagcccaagacccgaggggtcctatgcgagctctttggcttctgtggagcttggaaaagacttttacctgcgggcggggtctgcctgagtctctcccggtaaatgcagtgacccacggcgcaggacgggggttgagaggaaaagctgagagtatagccttggtccctaaaacccgtttgcagggcggggaattgggtctaacggcgggagggaggatgttgtggggggaattcgtggggggcttcccagctgactgttgtgtggtgactgcactctctgatgcatgcttctctgggccaggttatctcccaaggtccaggggtgcagctaggaggttctccaggcgcttctgaattgctgctcctgcacctccctcctcacccggagtctttttcaggcctaacaggtgtggacgcctgtgtatgtgtagacagtctggttctgcgccatgcctggccctcatgccaccaacgctgggtttcaggagccccaccagccctgaatcgaggctccacagggttggaaggatgcttaccagggccaagagacctcgaggtggggctgcggggcagatggaccggtggggtgaggaagtttgggccacccgagtggccaagaacacctccactccttaattccgctaatcatttagctcagcagggaggatgaggttggaggctgatgcacccgggtagtgggttggttaaataagaggctgtaattctaaaagggggagagggagatgagctggaggtaaagctgcgtcttcctttccacatttggggctctggctgcctcaaattgagcctggaatgtttatacgcccccagaactgcctcgcagtccctggtctccatcaaccacctgagaaacttcgctctcaacaatagatgattataatgtacttg

SEQ ID NO: 1863 - DNA, 176 bp, Homo sapiens
ttgctaacaacattgcaaacaaatcctggtctctctcacacaaaaacctcctccgattttcagtcactcctacctccttgaattttgttattcacctttagtctactggcagtccttggctagtctagaatccaatcctggctggctgtcaacagcccttatctaaaactcctgat

SEQ ID NO: 1864 - DNA, 207 bp, Homo sapiens
tctctctctctttctttcatttttttttcagccgtgagtggaatctgggacccttcaaatgccatcctcctttcaattgggccatttgaagacctcgagtttacctcaaacttcatcccttccagcaccagcaaatgcccaaagtcactggccaatgacttatgcttttgttgttttccttccctaacaatctcccttgtgtgacag

SEQ ID NO: 1865 - DNA, 1568 bp, Homo sapiens
ggggtcaatgaatgcatgttctcaggcttactaatagatgagaccatggtagatattcccttgagcttccagaaagcacccagcaagttaatgcattcatgccactgtaaactagcatttgagtaaggggtggtccaaacaccctacttatggaggcaaagagcagcagctcatctgcagaccactaggggttgttcgcaatgcaacagaaaccacgtcttatccttgacagggcagccaataggtaatcatgttttacacatgtcattttccaacttcatcttctttcatccttctgtagtatctcccagggaagatctcatagaagtaactgcatataccagtttcaaacaccctcaatatgaagagcatggaactctgcattcagctacctgggcatgtcaaaagcacatcatgcaataagccaatgtttagtatatggtccaacatggacgtggtaccttcacagctcttatctgattgaaatgcatagatgtggataggaaatgacatgcttactaattttctgagaggaaaaaggggaaatccagtatagtgactgagtgaaaagttagtaataaaaggtaagtgacccagacagggagtttcctgagcaagcataacccagcagtttttagccacacttctttcatggctttctcttcaagttaggttgacagatatctgatccaatgcttggccatctactgaaaccacctcttaccattccaccaggtaaggacgtcagcaaaaagccttttcaccacaagtagcaacctactttccaaaacaactccccgcacttcaaactaaaccaacgactaagtaaacccagattaaatagagctttatcaggatggagtttgagtaatctctaaatcaacaaattccagggaatgtgtgtacagaatatccattatacaaatgtcagaccacaaagtcaaactctttgttgagatgctgttaaggccttccctaatacagccaatatagcagagtgggagaagcagggtcatgctagcttctattccagagcctgtttttccttatgcaaaggccagtaaagcaaattttctgcagaattattttagttgttcctaaaaagaacaagatagcctttcctcattagtctgaatagacagctccttttctgagttgctttaattgctgtgggttaagcttcactatcacacatcctcacaaccataatacaactggcatcatttggcgctttttgacttggttaagtacaaactacaaagtccaagatgggaaaggtcatttattgtctgccagatgggatgtttcaaaaggaaatgatttagtcacatcattaggagaaaagggaagaattaaaatgtatgctcacatacagatttcggtacgcacacaaaatgatcagcacaggaaaacataaacagtagcccaacagcacacaagttacagcacacaagttacacagacttccttaaatggtatcttctacattgatgttgaaaaatgtggattgctattttaatactgctgtcataacagtctagtacaactggtagcatgaggctgaatat

SEQ ID NO: 1866 - DNA, 87 bp, Homo sapiens
tactactcatgtgtgtttggggcatatatcttatttccaaaactgccttataatctataaaatgaggaccatatgggctgggtgcag

SEQ ID NO: 1867 - DNA, 192 bp, Homo sapiens
cttcctgaatattattcctttccacctctccttaggtgtgtgtgcatgtgtgtgcatatgtgtttagtattgaaattatgcctatatgtagaaggcacacaataaatacttcttgtcatttactcagtaatggacattgatcatttaccttttacactaagtgagaaagtcttaaatgatcttgattcatga

SEQ ID NO: 1868 - DNA, 253 bp, Homo sapiens
cggaggctaattaaccatagtgaatcagattcattttctatgctactactgaaatatgaattagacaatattatagataaagctgaataatatgacttgttttaatacagttctaactcgattttctacttcaattccattcttcagccattgatatttggctttttaaaagctgtccttgtagtgtcatatggtcaccagataaactctgcagtgaaggctctttagattcaaatctatgttgaactatttc

SEQ ID NO: 1869 - DNA, 363 bp, Homo sapiens
cagagagtaacccaaagcttaccaggtgatccttcttagtaaaagggatttgtgggctgtggatcagcttcccactgattcatctgagatgaagacaggaccctccatcctgcaaaaatgggtttgaaaaaagaaaggaactctccatttacacgtgagaatggctcagccctaagaatgctgcttgcaggttcactgttctgcatttagaatccaggcctagagaagcagcacggcttgcctctgctgtgaatcagactctatcttgtgttgttttagagtcatgtctacatagctgaaagatgatttggatctttttcaagaagagagtggtaaggtgaggtacagtgaggcagaagacaa

SEQ ID NO: 1870 - DNA, 2259 bp, Homo sapiens
actctagcccttcactgggcagaacgcttttctcctcttctacagctgcccacggaatgctctgaatctaggggcgtactccgctgaaaggaagatttataaatgctcacgtttattagctcctaattgaggatatctgccagacacaataaataaagttgaaaaacagagtgctttggagagaaagtaggctaatccgaagctttttattcaggggatgaattctggtcttcctctctgtatatgggacactatcttgacctttctggctgagtctattagctcagaggtggcactccagtggtcaagtcaactggcattcatcaagcaccaaccacaggcttgaaatttatattagttgttttggaaggttccaggagaagacaatgtagactcctgaggaggggatgatgtaggtgaggagagaggctaatggcacatgaagcctgcaaaactgggctctagactcttctcattgcagcttcagagtaaatcaagtaacactgtctgtcttcccagaggtacccttggcagagaccagcaggatctgttgtttctactgttggacgcgtttatgggccctattggccgatttggcaagcagctttatataaaatgtcttccggaaccatcctttcccctgtgagtcagtcatcctcagagtcctaattctgtccagtttgcatcaggcctcctcagtctctgtagcccaaagcacacgatagggtaccaatgttcaaggctctgctttattttgaaattcagctggtgaagctattatattctacctttctccaagtagtatgcaatgcaaagtggcaattttacaccgtgctagcccaacataaattcacagatgagtgcacaccttatttggaataaagagaaacacaacagttattaaaggggtgattaccttcccagggaccatgaatttaaaattatgcaaaatcggaggtcggtctctacaagttcacatagtgatttaaatgggggtaacaatgaatataatatcttctaacatgttaaaacttccacagcaaacctcttatataatgctttgttgcttcattgatttgataagtttgtgggggtacattttgcattcatatacgacgtataaagtatcttgtttgctttacaaaaatgaaacatcaataataacaatcctcaggttgctatgatttctctgtcattcatactgagtgctcagtgtcaggaacagcatttgttttgcccttgaggaatttgcagagcagttagtaggtatcggtgtcctttgtagtggttcaaataacatataactatcgtaatatatttgaaataagccaattattatgccatttgaacatctatcctccttaagatatatcctgggttttactgaaggacttctctcttaataacgtttttctttatgatatgagcgtcctggctggaagagagctgagcttcagatacatggtgttggagtaaggagagagtcttttccctcaatggttatttgcatgggggctaaggagcctcctagttggggaggtgaacttgaactgtagcaacaatcaagattcaaacatgcatagacaagtatgatggcttgaagaggagactgcaggcagaagtcaggagacagggatggaaaagaagggtcactgtgagagaatctggcagggccaacagactcagccacaagtcagcaagtaaatggggagatgctgaaatgggtgaaatgttctccttcagtatggtggctggtgtttgaactcattttaccctctcttccaggggctgtgcacaccttaggtagaaagagctatacatgtgaactgaaacaactctctcaccaaattctaagacactttggggctcaaactactctattcaaactacccatctaaatgagcacagagacagaaaacgttttcctcacttcaacacgggctgctatcctgtcacggtaatgaacgacggaagaaggctggtggctggggccttctcataaccatgagaagaaacaataaagaaaaataggggtggtgtggtttggggtggtcaaggccaatgttgaagacattgatacagctcagaatagcaggcagcatccaatggtgagtggaagcccagattaattccaaaacacatataaaacatgtctacctctttgggaactcaaaaaatgtgaggttgggatgagctgcatgaaggactgcattacctgaacaaacgggtgagggcttgaggctctgggggcgctcgtct

SEQ ID NO: 1871 - DNA, 1723 bp, Homo sapiens
taaactgacatcaacccctcttcttcttttaattgatatgcagtcttagccctgttatcatctctgatcttgaccatttcccttagccactgggcaaccaatgtctccttctgaacagttgggagaaatgtaaattcactgttttttctccagagcagccagaggttccttaatttgcatcgttatatgagtgcaaagcatgatgataaaatatgcaattcttaagaaatgtcaaagacagctcattagatcaacttttttttctgtgtatttttttttctttttaaacagggaccactgtgcttcctttcaagtgacaagagttgtgacagctgctctataaggtattcaatggttaattaagacacgagtgtcattgctgagctcttttgtgtttcatagaaagcagttgctaaacagatgaaagtaggtctgaggcaaggggtagcataactattatttcaattaataaatagctctaaaagtgaaggaagtgataaagccctcaagagcgtctgtatctgccccggttctgtcaggaaaattaaacagagcacttgtgattgccattgcttctgtttaagagatccaagcaagtagggtcacctgtgctgagcaggttagagccggcctggttcttggggcaccccctagtgacatgttcctataccctaggatatccctttccttgctactgaaagaaatggtgctgaattcaccttgttcttccaccctcatcatcctttattctccccctctcttctaccaaagaagccctaaaatgtattttcagataaatatcaggaaagcatttataaatatttcagaggtgtttcataaataaatcagcaaatctacaaaaagacttctctcttttaatgagatcttgtctgtggtatatcccttttacttgagcatcattaaaaccagttgggaagatttttatactggactctcttttcgggggcttcataatatatgaacaagcctgctatgcgtctgtgaaacatgtagcctcttcttctgacagattaggcagccctggcgcgagggaatagcttttactctttttaaagtaaatactaatcaatagcaactgtaccgacaaaaaccttcttgctgcctaattgcaccacagctactcatagaccccaacagaattttcccctagatgtaacaaaattaactaccaggggctgagctagtgaattatcaccatctctctattcaaatgtaattaacacaaccccccaactaccacatgtaccattaaagtaccatttgtatgtgtaattttcaaacagggtctaaaggtcgtgcccacatcaatcttttcaacacacacagctgcacaggaaatcaaactggcagggaggtggtcgcagccattctaggaaatctctccctctctcagatattgtttgtagtttctcttctgcagcttaatgccctctgtggtctctttggccgtgtcagaaatagccagactgtatcagaggcaaacaagtgatttaaggaattttaggaagccaatctagtacccagccctggccaatccaggggctagctatgcagaaatcttactgatagcttgggatggatactacggccacggtggttaataataactaagatttttattgtacattcagattataaaaaaacttgtacctgcatttttcaaactcattattattattggcaattgtagtaataccagggg

SEQ ID NO: 1872 - DNA, 27 bp, Homo sapiens
gacacataatcactttgggagggaggt

SEQ ID NO: 1873 - DNA, 134 bp, Homo sapiens
acagaagagtatggaagaagaggcttggaggcaagataaaggcaaggggcagtcattggggattcatggaatagatgtctctctaaatgtctctcatgtcctggtggccattccatctgtcactttcaaaagtc

SEQ ID NO: 1874 - DNA, 1318 bp, Homo sapiens
ggctcttcatttgtgaattattcgtgctagaagaggccatatgtggaaatttaacacagcaatactttctcaaaacttcacctgtaatgtgcctgttaggactcaggcacccatgttgtcacaaagccatctcttgataaaaggaggagccctgggctgaggatgcccacatttagcgttttttttctcagaaatactctgccactcccagagccaacacgtacaaatagcatttgctgcacaccctccacttcccatgtgtcatttggcaaggctgccccgcttgtcaagagggctatgcaaagtcaccaaggtctgtaactccagttagaactcaaacactaatttttcagcagcagagtctgttgtgagaaaccttgctcccaggtgcacagtgaacacagagggtccttctctaatgggactcccttgacttcttccactcaaagacgcctggttccagcctgtgaggctgtgcatggggtcagctccaatgctcggaacgtcccgcctccacccagatacacactgaccacatgtgtctggggctcctgagtttttctctgcccatagctcacccagggcatgagtgccttctgcagtttagtttatagttgatccatgctggtgaggcctgcctctgagtcagggccaccattagcctggccttgaggggacatgcaccttcatgcctgagctgaccgtagggtgtgtgtggagggggcgcttttggtgtccagaggcacttggcatcacattatatccatttaaatatgttttcccttgattctgaatgaactgagagaaacaaaaaatactaatcaaaatggaatgcaaatatccaaggctcctttctctcagaaaatgccctattttcccccctccatggtactaatgttttagaaatagaaggcacctctggagagacaggataataccaaattttcaaatctgtagaaaatgagtacaggggtaggcggcactattagtgctactaaaaataagctttgggaagctacagtaaatggaaaaaccagaagagtcattccttttttaaactgtactgaaaatcctgtatgttcaggagccattttctccagagattccaacaataatacttggaattcaatatccatttctacagtggtctctctcccattttgtccccctcccttcaccactgccccagtaatgcaggctaaatattaagcttattacccccacagaaagcgtggttctgccaactgaacattgtgccagataccaagaattgaggcgattatgccctgcatgctgcttggtatactgaagatgggcg

SEQ ID NO: 1875 - DNA, 1661 bp, Homo sapiens
tttattaaagagagttctactgtagacaaacaacccagggattgtttgaagaaaagggatatcccctcagacctggggatgcatttctccctcagtggctaaacctctttgtcattattacctccagagagagacacccagggatctgctcacaccacccatctccaggcaagttgaagcatgtcctggaaagccacctgaaccctggacagctccgcctgactagagaaatggtggcaaaggaattcttgctgtggtcccagcggtgagcataacagagttacctctctccaccccaaatattcagactgcaaggacactggctcccaagcttcgacctgcttggagttccattccaggtactctgctgatgtctcggccagcctcagccacagactcccagctgagctgagctgttctgaggagtcaggaaatttgggggattttaacagagaaacaaagcctggcaccccatgtgtcaaagctctggatactagctctttagaacctaggtgggctaacgggaaaagtcaatgttagcagtaaacccaagatcaaaacttattccatgcctttccatcttctctcaaacatagcctttatcgaacgattgaaccctcacacacataaataaatggagaaagatgtactctgaaaaaaaaccatagaaaatagagtcacaagttatttataaaggggagatttgttaaagtagccaatctacttccctcattttataggcagagagacagaggaagagcaggttgaaggttctgaacaggatccccactaagcgtgggtcacattaggggacagaacactagcatgggcttttgcctcctaattcagcgttctcaccacccttgttgttccatagagcctctggaaagagagtggcctcaagtgggactggagtgaaaggccaagattgagaacgcctacctattttttacaaggtggtctggaatgtattattattttttttccttctttatttcagtctgggcatttttgcctcttaaaagcagctaaccctttaccacggaggtgatgcagaaatctactcatcaagtaagcctgaaagccctttgattcctgcagaaaaatctatatgtgcccttcagcctcataattgagttgcaaaggggaaaaataaaattgtttcctggctgtgtggagccattctacccaacatgccaataaaaagcaagtggtgtttttgtccataggatgtccaggttcagagtcagatccatgaggctaaacaagggctaggttattaccaacaaatgattacactccaggttgtattgaacagagtgagatatgtgaactcttgagactaattggaaggggaaatgtcaatgttgacatcccctgactggattccctaaaccacagtggaaactaacccagaatcttaaaaatgctggcttccagaaagccctattcttatcaggaaatgtgaatattaatcccaggcaagtcacttagccactactgtttttctttgccatcagatagtaatagccatctgcggtatcttttttcagaaaattatttggaagatcaagtaaatagagtagagcattttaactagtgaaatactcctcttattcaatcacagttattctctgcagtatgtggaagcaggttaacac

SEQ ID NO: 1876 - DNA, 167 bp, Homo sapiens
cttgatacatgcaaaatgcttttaaaggttaaaagagtgatactgtaacaactaattgaattcatccccacactgtcagtcatgtcaatatttaggagttcacacttctctccatggacataaatcatctttatgaggctctggctgttttttttttgttgttgttg

SEQ ID NO: 1877 - DNA, 462 bp, Homo sapiens
gactctggctgtttttgtaactacagtaagctcctctgtgacggaagctcctagttgtatctgattcactggtggactgatggaatgcctggactagtcttcaacacaccttctgctctcaaggccatttccacggccatgtttgagaacatcagatcaacccaattttctgtcatactcagtcagttgactttactggcggacaaaatagatagttgccttcctgttgtgatttctaggatcttaggggaaagcccttcttcttcactacccttctatcccttcccttaaggttttaaatccttgaatgaggattttaaaaatcattctagaatgaaagacaggtttaaagtgcaaatatattaaaaagccaaggacgcattctttaatgagtaagtaaaatactaagcaattcgttttgggagaaagaagggctaaaagagaaaagtgtcaggtaacgga

SEQ ID NO: 1878 - DNA, 119 bp, Homo sapiens
cagtaactgatttgagggaaggtcacagaggtggagaaagggcacaacaggcatattagaaactcctcagtttgtccaatattttgcttaaggcaatgcctgttaaactctctgaacca

SEQ ID NO: 1879 - DNA, 65 bp, Homo sapiens
tcaccacctctaggtgctagagaaacagtgtttggggaatccattaacaggtgtgatttaaaaat

SEQ ID NO: 1880 - DNA, 1492 bp, Homo sapiens
acaagttcaatttgaaaaaaatagtgctttgaaaaggtatcactgcttgcccattatagcactatagggtttattcttactgataatctgcctaaagtaggctccacaaaacactgggtaagggcagccacgctttggaggacttcctctttccctggcttctgagtgattatgtgctgggattcaggagtgagctcagagctcaccacctcgtgctcaggctcagggaggggcccttggtgtggacatggaaatccctgccatgtccatagcctctatgctcaccacctggaaagttacagagagctcccagttacacctctggtttctagagccagtagagcaagcctgtgatcagcccctccaccccagcctcctacagccacctctcccaggaaagcctagaggaaattggccaacgtcttggtattccattctggttgccaagtgcccttattgtttttgcatttctaagagactgtcagtacaacttcccccgtgactgccacgtgacaggctgtgctgtcctttatctcagggcaccaaatgacttacttcattccaggtctttctgtttcactgtgagtcaggtggaaaacagaaaggtggccctattttaagggaaatgttaaaacaaagacaatgctgtgctttgctggcatttgttagcagcagacacggttaaagaatggctatgggcaaatatttggatgactatagaatctgcttaaatactatggatttactgtatagggtgtcaaagtaacaactgtagagttagagtctattaaagggggtctcaacaaaaaatatttatgcccttatatgcatgctgctttgtcttttgaaaattatctttcctgttttttccatctcatagttccctccaaacaattgaccactccttttgccatgtcactgcttcctatggaactcagtccggtggattaagtgtttctgttaatgtctgtctccctttcacactgacttttgtatgaaagggaccgtgcctcttcacctctgtaactctagtgtataccatggtgtctggcaatagatgatctgcactccattgactgggaagaggctgtgaaaacaaagacgggtgcacgttcagagcaaatatttcctgctttggctgtgctaatttgctgtactttacacagtcagggaatgatgtgtgatcatttgttgaattaagaaattgttttggactcaagaagcaccaaatgtaaactgcaatgtcagactgcgagagaaagggtgggaggctttggggaaagggctttcccaaagtgcttgcccatggggaggtgagggggaatgcaggctcctagccacagagaatgaattcattaagtccaccaccatgctttgtgagaaccaggcagccactcctccttacatacaaccccagtcagatctatagccatgacaagaaatacaaaggtgtgctttctatttgtggtttatggaattgccttcgggattt

SEQ ID NO: 1881 - DNA, 318 bp, Homo sapiens
atttcatagtccagctggcttctttcccatgttttttttctttaactgtgcactaaaaccacagtgtcccggaataaattttctattgaacatctcacttgactgggaagtaatctgtgaatgtgataaagaaatggagagcaaatccttggaaaccaaggcttgggagttccatcatttaggaaacaaaagcagtcaagactaaaaatctcagacatcgtaaagtgattactcaccttctgaaagaccccagaaatatcagaggacaccgggggtcagtgggccatccaggaagaagctttggtgaaggggagggca

SEQ ID NO: 1882 - DNA, 278 bp, Homo sapiens
gattttaagtcccaggagggcagaaacaaggctatgggcagttatctctgtagcctgctctccccagcatgggccagaagaagcatcaagacatgctttctgagctgcatttcagatcatgagcattgggacttctttccccaataagtggtctgactgaatcctggccactgcctccacaggcactcacctacagagtgctggccctggaggaagttctcaggcagcactgattccactgggggggcacaggccccagtgcagaggaggggctcatt

SEQ ID NO: 1883 - DNA, 44 bp, Homo sapiens
aaatgaggaagcttcggcttgaagaagtggaagaggaagcagca

SEQ ID NO: 1884 - DNA, 671 bp, Homo sapiens
gcttcacataataagggctcctacaggaaggctattagaaaaagttcataaaacagcagagacatgggggtgtttctttccctgattaacccattatttcactcaccaacatgtcacatctcaaattgactggaaggaaagaaaggtttaaaatccactgggtggggcactggagggggaggtgaggagtgatggagacaaggcagttctgccgactttacacttttcccagggctgttcctgtatgtgtcgtttgactgattgggtcaaattacacaagatctagctagatattcagattccctccaatgcgtctgtgttgtgtaatcctccctgccttgtaaaggaacagatctgattggccagggattgcacaggtggcaacttcactgagattcacaatgcattggaaacaagggaagagaccctggtattctatgacaaacgtgcagacagtctaaaacatcaggacaacattttctatgtgatttagctggtatttctgagctggaataattaaacagagatctatccacttgactaaaagaggaagcagtcgatgaggaagtcagtccctagctccctttgccccgaaatatgccaattctgaatatttcgcatcagcttcctcttaataaatagcttaccactcatccatccctcgaaaatat

SEQ ID NO: 1885 - DNA, 1242 bp, Homo sapiens
gtcaagtgttagagatcagggtagaaactcaggagttaactgcacggtgagccctgatctgtatcacacactcagggcctaatcagaacatgctgatgtttcgcttagcatacattgcttattgcaactagaatatttctcaaccaacatccttcttaataaagtctaatttgggccagttctacactgttagtgttgacagggaaattccccatcgcactggtgatgggagggggtggtgctttcaaatcaagccttgaagaagtatccggcttccagagcccaaaaccctcaacagaggagctgcttcaacaacttctgcatactgccacctggtggggcctggacccaacttcatcacagctcttcagccttgggcacctacccgcctccccaaacagatgtaatttaggaaaatgtcatgcattttcaatccaatttactggtgccttccacattgatcagacttccttctcctttttcctcccatctggttaatataattattgcttttacgtggcaaagccattttatgtaatagctttgtttgttactatggttacaagtttagtagccctttggaatataaatctatcatccctgaaagtagctttctgtgtgtcaaggtgcagcccttatgtaaggagagtaacagcgttagttttctgtcgtaaggaaagtggcctttcttggtcttatttttgaaagttctacgagcctagcctagacactcccgggaaactgctgggtgctgtcccactttttccctctggaattttcctaactgacgaggcatccacgagcagctctatctgggagaaagtagggaaacgtcggccgaggggcagctgtgtttgctgggccagagccctcgcattgcataactggtgtttttcctggtcagtgtactcttggctgatttatttaccagttaaaggcaagggctgagaatataatctctcaggagttaagtttctttgcgtgtaatccctttccctcacgcatctgaagcatcggcccttatttcctgatggaagtggagttataatctccctttggaaagtggtaagagttcagtgctgggttcaatctgccaccctcaagtgacaaagcgtgacagcgtctctgctatagtgcttcacacccaactgaatcagacgcagccctctgagcacaaaagtgggatggcctgtgaagctgggctttcttcccattctcagccagtaacagcaaaccttggag

SEQ ID NO: 1886 - DNA, 1130 bp, Homo sapiens
gacttaatgtctttggaaagtcctggttgctaacttaacagagcctcactttccagattcaaggaaccatgagaaaacaaagagcaggcagtatcaatgccttcactaaagccttgattaagccaaactgaacaaacatcaacaatcttcttccctcttcaggagaaagttactggtttggtaggccattagtgaatttccagtggctactaattaactaaccatgtcattcatgtttattatcacagagcaggtacgtatttatttacaccactcacacggcaggataatttgcagttatataatttcatggtaattacgattggaattgccatgtagaaactgggcactttggagatgcatgattaccaacaactagctaccttggaattacccattaatgacatgattagttgtggctttgtaagaaaatgttgttatgaaagggactttatcttttcattcccaattgacagaaaagcaggaaccttggagatatcagaaatattttttttcttcttctggcaggtgaagaatgtagttgtgcaggtttgtcctgtttctgggcatgtctggggtgccttggtgacagggagggagcagaaagagatgtgtgagcttgagcaaagggtgcaggccctgagctgtaccaggctagtcttcaggtctgttgagccagggtacagccaggaattaccaacttgttaggcagagagtaaggaagctcagaaagcccgtgcttgagctaaggggtacgaaacccaggagactgaatgactgcctgtcctctgctctgtggggaccaagagaatataaggaaggcagaagcagaggaggtggtaggttccatctacttatgatgctacgaaaagacatgcggcttatataatatgcactaggcatgaaccaccctgcccccaaatacaaaactggtctccagactgtatttcttggcaacagtggcctccttggcttttcctccacatccccttgagttgactatcctctgaggttgctcttgctattgattctcactggatatcactgggcatggggaggagaaacccacacaacggggtgcctggcatatgaagaataagagaaactttagctcttagaactgcaggaga

SEQ ID NO: 1887 - DNA, 160 bp, Homo sapiens
gattttccataatgcaattccttcatgagggaggagttgttgatgcctcaaaattgagactaggctactatagataatacctatatagggagtgcctctgcatccattatagaggctactctgggatatttaaatacatattttttacctgattacggca

SEQ ID NO: 1888 - DNA, 451 bp, Homo sapiens
aatccatcttttccttaggtaggagttttcattacggttttcttttcctctcttttgcctgatatctgcttttgttttatatattgttttgatctttttgtacctatgtttttagtataaaatttctggatgcaggtagggctgtcaactaatcaataacaaataaacaaataataatcttcatgcttggtgttcaaccatgcaggaaataaaatcttatagaacgtacagaagagccaggaaggatcacacactccactgtgctaactgcatacgaaggagaaggggaagaaggctcagttttagtggaaaggaataggaaagagaagaggcctcttcctttatcagctccctcacagcttcagcagcactatctcaccccactaaccaaacatccaaaggacttggaggcagaaaagaaagcttccggagaccttggaattatgtatgc

SEQ ID NO: 1889 - DNA, 28 bp, Homo sapiens
cgaatcagccattttatcttccacctct

SEQ ID NO: 1890 - DNA, 700 bp, Homo sapiens
ccacatcctcagaccatggctgtcacctggaactgtcagtaggccacccattttaggtctctcttaggcctaaagtcaccaagctttaccagtacccaaactgggtgctaggaacaacaggctgggcactaagatatgacagatgtggattaccacataccccagggagaagcctacataccatgggttcatagttaacagcgagctattacaatagatattgttcatcctcaaagatgaaactgtgatgagaccattgctataatattgacaaatcttcaggtacaccaaatgtgaagatgaattttattgaaatcttcataacatttttccatttgctgatagtttaaacaattatgttcatgtttctctctgtgagatgacttttggtgtcctgaaatgacatgctattgtgtaaaactacagatgcaggacacctcagtggagttcttttcttgcattaaactcacttcaaggaagatttatgaagccttgaaggtctggattgggccttggggctcatgatcaacccaggaccagaatatcaaggcctaaattgcagtcttggttctacctcatagcctcctaagaccctgtgttattctccagtcttatagaactaatcacataaagtggttaatttcttaacctatttgtagagacaaatgggtgatagaaagaaaactggagctcctggttc

SEQ ID NO: 1891 - DNA, 137 bp, Homo sapiens
ctctaaaaataaagtctctttaagaagatactcacatccatgatcattaaagactactgctactatcctatttcttgtccagttttcctaactcataaatatattttcacaactgttttgctcaaatcaagatccaa

SEQ ID NO: 1892 - DNA, 719 bp, Homo sapiens
tgcatttcttcattcttaattaattcaatgtcttaacaaatcacagagtcaatagataggaaagctgtttatgactttggccaccaatcacataatactttgtgaggagagaaaaaagggtattgtcatgaagcttcctaaaaacacccagagtttctgtctgtaacactcttctgaattctttagaaccatggatggttgctgtcactgtcaaaactacatctaatactataaaggaaagaccctttaacacaagactgtgaatacaaatggcagagcagatactattgtcacacatatatgcagaagagattctgtaaggggtatttccgggaagacagacaaggtgtgatatctggtgtcactgtgtgtatgaaagaagcattttaagatcctcaaataaacataccgcccaaattaaggtgaaagtaaagcagacaggacccactttttgcactttgtatcttttctctctgctctttcagcactgcccaaagaagctgtcgttttcatcttgcacacaggatgccgtcctctgaagtctgaacaaaggccggatcacatgcctaagcagtattttaccttgtgctgattccttaaaaaaacagattgtctcctggattgcatgcatctagaagttcttaccacgttttattaaacaaccagctaatgcttctgcttcctctaaggagatcatgagtccccccactcccgaacaa

SEQ ID NO: 1893 - DNA, 1139 bp, Homo sapiens
cagatgagagtgaaaagaggctgtgacgaaagcactggacgggaagctggagacctgaggtcatctaggcccctgacactcagagtcacttgagtcaaggcaccaacttccgtgggcttccgatgatttctagggtctctcccaagtctttttaaaaaaggcacataatcctaaaatgtgcttacttactgctttgctgtgttgatccacctagtgacttatatctaaagactaattgctaaacaaattactgaggcctttccgaacgctccacagcaacaaaactttgtttttcccgttgccccataccttctgtgtcatttatgttcccactacagatcacagtggcaacaaccccacccagaagagccaggaaaaaaccctcccctctaactcaccatagggcttgccatgtgctagctgtggttctgctaagttgtgctggaagctggagtgggcaagggctcagaagccttctctttcccccttagtccatgcctggccctgctgtgggcagagctacgatgactgaccatgatcatgtgtgagcacggggcagtgtgttttaaggggtgagcactggcagaggtgggtccagaaagggccagcccactgaaaacttcccaagtgggtgaaactcaccttggcacttgctctcctctctcctgccctctatcccataccccatgtgtagcattccattcaagaaaagaactctgactttcagcttgttgacaacttatctcctgaaggtgttagctgacaacttttctgaggcagaagatgtgaccaatataggtgctgggagaacggaaggaaggggttgagttacatttattcagtactttttcactcatttaaaactaagcacacaactgagaggagtactcttctacttttaagaaatgttcttattgtatcactgccgctaatatacgcttatagtctaaaaatatagaaacagatttgaacaaagaagaaaactaaagttacacatactatagtcctttaaaattttagagccttctagatcttttcatatatttataagtgaatatatttcttacgtgcctgtaatcatacttctgctcatccgatttaatgtaattctattgtatctgtaatggaatagaaattct

SEQ ID NO: 1894 - DNA, 178 bp, Homo sapiens
taatcagtaaagcacgaatacacaggaaaattaagtcgtgaagcactaaaccacagggcggtgcgtggaggcagccaggccatgtggtggaaatactgtgaactataacaaccatagagatatgaggagtgattattgataggacacattaccatttccaaggatttaaaggtaatca

SEQ ID NO: 1895 - DNA, 531 bp, Homo sapiens
ggtactctaacaattgaggaagtgcctccttatcacatcctgacaggcggacccttgctgcagccacaggtgtagactgctctctcaatggcattttttgaaagttgtcagtttcttggtgctggaacctctcccagctcagaagttgtcaccttcagactatctatcttctctaaatgggattggcttcgaagagaatatttgaaatgtccccatattcaaactgaaaggagacaggctggaccagtaagaccagccaagagatgttgagttacacatattgtttggggccacagagccctactctgtttctcctccacctgtctgatcccacagtactaacaatacattgtctgtaggcccagttgtaaagactctcgcccctgtggactggctgtcctcagaggggagtcagggaatccccagcggggctgtcatggagctttggcccagcagccccacagctcactcagaaatgcactgcatgcctgatacagtgaatgatcatcagaccggccattggcggctgag

SEQ ID NO: 1896 - DNA, 662 bp, Homo sapiens
ggtgatgaataaatgggtggaaattctgtgcttacgatgagtggaaacacaacggttggtgggaattaaactcttaacacatcacatggtgaccaaaaatgctgaggccatatctggcctgcatggtctgacatgattggaggcacccctgaaggtgggaggatagagtagattgaatgagaactgctcttgaacaactaggatacaaggctgctatatgaggggccagaaaagattgcatcagggcctggagatggtaacattcatgacaggtatacatctatggttttggaggcatctccatatctgcatttcttataagcttgtgcatatagtgacacacagctattcgaaagccaaaagtccctcaatccaatgacatttggaacagaacctggagcataacctggaaggcacctgcagcagaacctggaaggcaccctatctgacctggcatcagctgacacctggctgtctacagctttccataagcccttgccaaagtctcacactccccaacaggcccatggactcagcagtacttggagaccgagtcactgggtagattatagagttatcccagcccccatcttgctcaaccccaaccttgggtgcattgacttcccagtgaaacagaacatcgaatgacattttaagcacag

SEQ ID NO: 1897 - DNA, 240 bp, Homo sapiens
cacaaaagatgtccacaagctactatatcattgactaaataaaactgtctatatgatgtaattaatccatgtatgtaagtacatccagatagactgtacagagagagatgactggaaggatcctcatggaagttttaatttactacctggctcttgagatttggggtaaattttcctctgtgcttcctatttttctttacagttggaacacttcatgataagtgtgttgttgatatcagg

SEQ ID NO: 1898 - DNA, 430 bp, Homo sapiens
aagccttggaagggaaaaagagtggagatctctccaaacagttgaaatgaatttctaagcaggtgcacgctagtcacacacatccttcccacctctctgaccagataggaagtgctcaacacatgtggaccagttccctactagctgccaggtaaccaatacgtgaagcaaaatggggattctacaaagtgagagtcctaaggaagctctatcctatgcgatatggaatggaggcaaaggatgtgtcctactgtcatctgtaatgttcacttcccaggacccagccatatacttggcagtaagtagctgatgaacattccaaccattattaaataacacttctttcaatttcgaatatagtctttgcagcttcctcttccttcctacttctaactacaggggaacataaaaacctgaaaaccgtctgact

SEQ ID NO: 1899 - DNA, 35 bp, Homo sapiens
ctgaaaaacctaatccctgcagaatgcaagcgtca

SEQ ID NO: 1900 - DNA, 641 bp, Homo sapiens
ccttcctcacagccatgcccttgtttggggcccgtgctttctcttgtttggactactgcaacagtcatcaagcaagattttcctcccatcctcccatcttctccaggtcacattccctggcactagagaatctctctggaacactgaactgccctgcccatatcttttccctgaataaatccctttaaatgttcctcatagactccaggacaaaattcagactcccctgcatctcacatgagccttttgcaacatattcatggaccacagtggcaccctgaagaaataatctttcacacacaacagctggaaatacttcatgttcctttattgtcaagtaaatgagggtttcttccaagggactatcctgtaactacttaatttaaggattaactaaaacaggaagtgctaatcagctcctgaaaacacaaccaacattctaggcgggaagctcgtggaagccaacaacaaaagcattcgcgctcagtatgcctgccttccccttggaacctaatacatggtaggacctcagtaaacactacttgccaaatgaatagactaagtaataatcagaagtggagaggttaaactaatacaatgggcagtgaaaagaaaagctgtttttcgttttcttatacccc

SEQ ID NO: 1901 - DNA, 188 bp, Homo sapiens
gtgctgggagcttctgatggtttccactgtgccatgctgactctccaggcaagtctaaagtaatgctggcaataatgcacagagctctaggcacaggctcctctggaaggtgccagacagcatacaggctggggcaccaggtgtacagctaatcatccccagagaggtttacctgagcttccaaaggg

SEQ ID NO: 1902 - DNA, 796 bp, Homo sapiens
aatcttgaattgtttggtgaagagtgtctcaagccaaggagcagacacacttgtgtgccccgctcccactcttccctcctttgttcttttctttgagctgggtccattggaggagcattgtatggtgcccctgctgggtctacaaggcccctttttggttcaattaatgagccataaataacccaatgaaggtgtcaacaaagagggtaatttatcataccttgtcaagacggcaagctttgtgaggcaagcgctcattcacagtctggtgcaacatgttaagatttattcctggccaggtccctcctcctccagccctccctccccctatcaaaatttatctttcacaggaatcctcacaggtgtgctgctttgacaaataagctatgaagtctggtattcatcactggctggtctttgttgagaggaaggcagcgggaaataaatttatgttagagggaaggtacttgtgattcaaacacactcaaggggagcaacgaggttatttccatcctcctggttctgcaaaaggcgagaaggagataatgctaggacagccactttcttcagtttttactacttgatggaagaacagccaggactttactgagatgcgcacttagctgtcagtctggaggctccagtcgcattctcttgaaaatgtttggttgggaaatcttacagtggagtagaaagtgctacaagacatctgatatgcccagaatcgccatatcaggaggttttcccgcttcgctcttcaacttctggcttcccttggagtgctcatcctgaagtg

SEQ ID NO: 1903 - DNA, 88 bp, Homo sapiens
gcctctgttcttgccttcagacgcatatggtttatggagcacattttggatcaacacgtgctgcttagagtctctggtgcatgcctct

SEQ ID NO: 1904 - DNA, 2413 bp, Homo sapiens
tggtagagctctagcccatcattctgcatagtagatacagacgaaaaagctcaacataagacctgatatgccagtctcctcctactctaccctattttccagctaagaaatactccaagtccctggagtgtgccctatttagtcatttctaaacaggaagagggaggagcatatcctcccacctccattctcaaggtctatataagccgagagacagaaagatccaatttcttaagtgccttccatgtgggacggtgggaggcatctttgagaattacatatggtctcccaatacagggagggaagacaaatatacaagtgacccaacaccaggtggcccactatgaagctgtagaaaacacctatagatgcaaagtgccaggagtcctcagcctcccctagcagatgtgaacacttccggacaccagccattcccttcccactttggaattaatgcaacagccttgtagctcattatgcccaattcactgaaggaagttagacttctgaattccttccttgaagtgtccaaggtaggtttcccactgtctgccctgttgagatgggacccacctctgtggttacactttgtatgtggtgactgtcatcacctgctcatctgctcacctgtagactttgaggtccgtgagcagagattcccaatcatttatctctgagccaagagaccgaccctggtggggcaaaaccagtatgttctaaaatgaaatggcctcacatctgcctatatgaggcctcttacgtcttgcttaaggataaaagtggcccttgaaaaacagaaagtggtctgttctctgagggtaaaagggtgtaggtgttccctttctacagtgttatgagagggacttaccccttaaatgtgtattttaaatggcagggggaagagggggaagaccacatggaagagtgactggtccagggtctggggaagaactccctgtctgtgagaaaattccacctgggaaagagaaggtgagtctgcctagagcagcagataggctccaggtccataagtggggccaggcaggcttacaggagtaggaggcacggaggcacattgggaggtaggctgttcactgcccagaggcacaaagcccctgtcccagaagtgaagggcagcctacaggcctccactggatgccctgccacccacgaacagcccctccctgcccaagcactcttccttactcactcctctggctccatggggaagcagaatcccaactcatagctgcaggaggaatagctgaagagagaagaggcctggcttcagcttccagagctaagccctgccaatctcccagactcctgcagtctttcaagtctccgacatttgattactcctttcttctcatgaagtgtccttattttgcctctagaaaacaggcactggtatcaagagttgcatggctgatgccaagacttaatgctccagagtgtcttgcacagggccaaagctgcctcttctggcacacacagagttctacagaagggcccccttataggccaccagccactgtgaggacctcataagcaaatgtaagggcaggaagagatgggacatggtctggcaaaaacctcagccttctccctaagctcttctgccttatgaggctgatagctcagactcaaaacagttggctgagttctccagctaaatattcatttctccagctaaatattgattccttcaatattaacaccatgtcagggagccatgttaagccattgcctcaacttggcactgcagctaaacataatgaaatgccagaaattagggtctagaattgattatggtaccaattctaatcctgaattctcaaagcaatatctagaaaaatattgaatcaagagtttttttttttaaatgaagatcctatactggagggagatgggcaacttctatttggaataacaagcagtatcaatgtctttgaattcaccttgaaaaccaatcctttggagtagaaagaattcatggtatttgaaatgtccaagattactaatgaggggaaaatctgagggacctgagaaggtggggttgcttgagaagcagtaaagcttctcaaagaagaaatggagatgccatgagcagctgccttggaccagattccaaggcagtgtcttgtaaactcagccacgattagggctgggtcattctggaccgtcctaaagagaaaccattaaaaaccattaattccttcagatatcacagctgcttactcatagtagctcattcataggtaaggaaactgagatctccctaagatcaaataagtaacaggtatgttaaaaagtttcatttgtttacgtgttactaccaagggccaagtttctccatgtagtgcaaggaaataatttctgtgcaacagctcgagatatgcagcttgagttt

SEQ ID NO: 1905 - DNA, 281 bp, Homo sapiens
cccatgccaagactccctggcattgttgagatgctctgagcttggctggcatgtgacactgaggacctctggtgtttgtctgcaaagggatgaatgctctttctgataaggaaccaaggagtgtggaacagaaaagcagctgaattctctcagtggcctggctctctcttgccccctcaatccctgaagagtgttgatggcttcctacgtcagacaacctttcacttaaaaacttactcctcttccttacccaggagtttccaggttgccccccacagtca

SEQ ID NO: 1906 - DNA, 128 bp, Homo sapiens
ccaatttcatcatcagcccaattgtcctctagtgccatgatgatcatactaatcttccaacccaaattctccactggctcccactgcctatggaatcatgtccagacttcttagcctggtattcaaat

SEQ ID NO: 1907 - DNA, 82 bp, Homo sapiens
catcatgccagggtatacacatctgtactaatgaacaaatgaatgaatttagaaaatctagatggatgttctaaaattatct

SEQ ID NO: 1908 - DNA, 543 bp, Homo sapiens
aaaaaccagcccagacacaagcttttcatatgggaaaaagcagaggcactggtgcgatccattctgttggccatgaaatgtctttgggtgtgtgcacacagactcccacaaaccagatgcaacatctgcttttgaagggcccagagaggctgggctccctcatttctcaaagtgatgagaagcgcattggagtcttgcagctgacagtcgttcggtaaagaaacacctacttagcatagccccagctccagctccacaccatatgcatcaataggggtgggtcacagtgccctcttggcagtaagccaggaggagatttgaggtttggttttgctgtgctcaacaggcagtcctgatctacattaacaagtctcctgcttccgtgtgactagctaacaaggagactgctgcctgcctcatgcagggagacctttcccaaagcttggcacctgccctatgctggcccagtggaggccaaatgggggagcagaaaggaagacattgctaaagttctcttttccactttccttcaagagactagac

SEQ ID NO: 1909 - DNA, 227 bp, Homo sapiens
tattggctactccaaagaaaggcaaatgaaagccctcaagccatcactggctggacaagaggtatgactgtctccctgcctccaggctctgctccattacaatctgtcctctactttcccacagaaagcacctttctaaagcacacatccacctatgccattggctgcactgcctgttccttgcctataaaatacaaactccacagccaagcttatgttgtctaagc

SEQ ID NO: 1910 - DNA, 349 bp, Homo sapiens
aaaaagatgctcacaagcatttacactgtgtactacagaggactatttccatgccaaaggaaaccatcaaaaagtgaagaattggcttgccaaccagtcatttgttcctgcactacaccaaataacccatttgcctgtaattggctggatattctggctttgtgtagacatctcctcgctgggagaaaagccagagttaatccttcacaaagggttgtttaataataaccagaaactggaggagagcagaaaagaacacagtgatcccacacaagctgaggaaaatggactgttcaaacccacagtgtccatgctgccagtaagggcccttggtgtggcctgaggtttc

SEQ ID NO: 1911 - DNA, 1524 bp, Homo sapiens
gaacatgaatatgtctctcctgattatcaccaccaaatacaccagtgaaaacatctatggctacatattactctaatgcaacactaatgcttacactggaacagaaaatcaggtcattgtcgagagtctataaatggacagccctctccatccattacttatttatgtttcccgccttttgcttaaccggccttgaggcccaaacagagaaacacaccatacataaagttaccagtccagataaataaaacatcagactcaaattggcagcttcatccttcattgctttggaggaggtggacttcaacagccagatgctgcacaaatgatcagcaaaatgtgaccctttgagaccgcagcagacaagtcattcctaagacgtgtatcttcccaaaagttagctttgccctttttagagaacattcttgtttactgcagacagaagacaatgatcccaaaataagtttgagcccaaatctctttgagttgggcaaactgagactgacattgttgaattcatcaccagttgaagtcaagggtttccccatgtggccggccctacagttactcagcctgaaggctcatcatggtaatattacccatgggaaggtctgcatagtaacgaaaccatcagagtccctgtgcaaagttccagcagaaaaacaatgatgctaggacccaatcctatctgatggcccagaggtatctatggccctgggggaagcccttcttagtaaaaggaagacccatctccaggaacaaaatgacttgccttgctccttacagtcttctgtctatctactcacagcagccatctcttagattgaacaaagtaggatgcttttacctagttttcagcttagccttgtgctaggcaacctgtgaagtggctctgatggagagagctggtgtaattagcagcacagggcacgtttccagaaacagcctggatggagaaacagagggcacccttgcacacctgtcacaccttcagcctctgctcaaaagtgtccaccttctttgtccacagtagctacagaagtgaaaatgtttgcctcggcatcctctccatcaccgtcaccatcacctagcccccaaacggggatcacagtgctctatccacccctgagagcaactgtgtgcagtcaccagcaaggatggttctgccagagtgacgggcactgcctgtgaccatacagtggcagcagtcaagaaacaagcccttctgctcaatacttcatcttttcctgtgtgctgagaattaagtacctcttagctagttagaaaaactagcagttattattgatgaaatgtgtaagacagacattttgttaggggcagaggagaaaatagtagaaatgtccagtcgttgaggactgtctgtaaaaccattcaaatcaaaccacttcaagaaggataaagcactgtgctgatgtaagggatggtcattagataagaggagtattacatcttatgctctgtgaaggaaagggtataggtcttatatttttttttaatccaatg

SEQ ID NO: 1912 - DNA, 460 bp, Homo sapiens
actcaacctgccccctctgacacagaaactttcatggagctcagtgagaactttaggaccagtgtaggcactctctgaattcttctagatagcactgagcttgagtatggttgttgtttaagagtatttactgtctgggtgattattctggctcatttcataaggcttttgtcttggtgagaaagcactcaccatcttctagttggaaagccaaggtcttccaaccttgggaaaatcctgcctcattatgccaagagttaccaaacagcacaggaaaatattatcacagatttcctgaaactgggtgagatcattcagttcaaagcctgcacaattctgtttcatatgcactgggggcagaaaaatgtatgattggtccttagagctcattctcatgggtgattccaccagtttcccagactccaacttgggtcttcccagtagtgtctgctaccaccaa

SEQ ID NO: 1913 - DNA, 218 bp, Homo sapiens
aggttaatacagagcacaatatcagtgataatagctaatatttcttttctttttttgcttatgatgtgccaggaacctcatgaggtggatcatattatctgcaattgctggtgaggaagaggaaggagagactcagagaacgaaaattagcagaagtagaatttgaacctaggtttttaggttcaagataggtttttccagcttgtgtacacaagcta

SEQ ID NO: 1914 - DNA, 344 bp, Homo sapiens
gtctatcttcaccctatcattccatttcccataattaataaagatgatcattgttaccatgacaattaagtttctgcagtggaaggttgcatgctgtattcaaatatagtacctgtgaaggtggtggccagtttagttgccactgtagatgatctagcttagaggtcgtgtgcaaagaattcaaataccttcacatttaaattctaaagtgtaaaacttctgccaatcaaaattagaaggtaatgtggcattaatgctactcactctacaccctggatacaggtacatggttagatcagttcatacaaactagaggagggaaacactcacttaaacattttaaa

SEQ ID NO: 1915 - DNA, 447 bp, Homo sapiens
tttttttaatactgggaaaaataaaaatgataattggtgcatttagaacattaatacaaatctgcctagatctgccactggggatacagattgcttcttttctttcggctactgaaaaaactggagatttgtgtgtaaactccgagtaatatctgtgaattaaataaaaaggcactggcccatgcccggcttcttaaacaaatcaggcttattcatgcaacatgcttccagaaatgtgttcaagtcctgtcaccagtgatggctcgatcaaagttatttgctcaggccattgctcgttggtccatttcaacttgctacgtcctgtagccatcttcctctctcagacctcttccctcggcatcgcagctcctgacctccactttggccttagtgctccctcggagacttcttgtcattccaatcatggattcactcactcattcactc

SEQ ID NO: 1916 - DNA, 1019 bp, Homo sapiens
gtattatatacaacaaactgcgaccttgttcccaccatgaaccaggcattctttcagcatggtagccctgcctctcaggtctgagaggtccaactgtctgggccagccttgtccagattctctactggacaaagggggctggagaggaggggcatgcagtcatcagaggcttcattttgtacaaattgcctttgaggtgttcttctgactggagcacagcagggacgcacgtgctcacttgcaactctgggccaggctggtcctgaggtacctgtgataatcaatccagttgccatagcggccttaagtgttcatttaccactatgcgacctggagcaataatatattatgcctttcgccagagggagccgtgccagcctcagcacagggcggccgtgtcggccatcagtcaccactccccttcacaaccttttgttccccgctcattatggtgaattataacagggggacagcacatttttcaggagagtttctcctgttaagtctgagagctaactcttcccgggttgttccaagtcggctgtgctagccctgtacccctgcaatgtttatgcacgggacagtgccgttcactggacttccctcttttccctcctcttgcacttagaatggctgaaaagcagtgtgtgtgcacatttctacaaggcaagataaaaaaccactccagtgtatttactataaatattggatactgcattttgttgcactctgtcatgtgcccgaaggcctatcctggtggtaaattacattacagaacactaaataggccatcatgtcagctttgagccttggcattgctacttcaagatgagtagaagatcacttccaaagtcacacatgggaggatcaggggccaacacctccaaccctatcagcattttttgaaaatgtttcactctaatagtgatggtgaacattctaagatcctaaaaattagaggctgggtcacaagattagatcactgaaagaaattaaagataaaattgttggctaagatg

SEQ ID NO: 1917 - DNA, 160 bp, Homo sapiens
tctatctaaataagatcttttgatgtgggtcattcatgaaactaaagcaaacagatgaagcctactaagatcttgaaggtttggattgtcaaagagcctgccccattcagccgtgtcattcagcacagcccgtgactgttcggccccaaggcagttgatg

SEQ ID NO: 1918 - DNA, 192 bp, Homo sapiens
tctggaggtgacagagatccttgatgtatcaagacttgccttaaatgttagggatcttctttttaatatcaggaaaatcaggtgatactcattagcttaagttgcctgattagtagtcacttacctttggaccaggtaatccaggtaaaccaggatttccatgtggccctggtatgccctgcaagtaacgaa

SEQ ID NO: 1919 - DNA, 177 bp, Homo sapiens
aaaataaaaaccttctttataataattagcatttttgttaaaatcaggagtagaacaaagccaccactaccactgcttctatttaacattttggttgccagtgaattaaaataaggaaaataaatactaaaggaaaagtactggacatgagatcatcaaatttgtatatcactttag

SEQ ID NO: 1920 - DNA, 269 bp, Homo sapiens
ccatagagcaatagcttaaatccagtctattttcaaaaggccagttcttgaagcacattataatccccataactactttatgccaaataaaattgtaacatgccaagaaaatagatggaatctgctcccatgtaactgcatctgggtgaatgttcacctctggccttgggttttataagggacatcaacgtggtagatgaggggtggcttgactatggtggtgaggagttcagaaactaggtcatacgagagcacagaagagaaactac

SEQ ID NO: 1921 - DNA, 69 bp, Homo sapiens
gatgctaaatgctatatggctccaatcaaagctaactcatgaagccatatccaggctcagctcctgcct

SEQ ID NO: 1922 - DNA, 240 bp, Homo sapiens
catttgtattcctgaagagttcccaagtgatgctgatattgctggtcctgggaccaccctttgaaaaccactgggcaaagcaaccatgtcagccaaccattttcacctctcagcattacatggctcactgtaggaaattcgaagccctggataggttgctagaggcctgagcttaccagcccaagagctgtggccatcccaggcccacatagcaaagggcacaaatatcttaaggcacac

SEQ ID NO: 1923 - DNA, 197 bp, Homo sapiens
taattgcaaaaatggctctaactgttcattgctcttttacatgccctttgccatgtgtctttgcagctcttcctatacaaaggtagaatctgtttttttttttttttttttttttttgagatggagtttcactgttgtcacctaggctggagtgtagtggtgccatcttgactcactgcaacctccgcatcccggat

SEQ ID NO: 1924 - DNA, 254 bp, Homo sapiens
cagctacttcttgcaattgggttccctcagtgttcctttttgctcttttagtgctttagtgctccaattccgatgtaacaaccaattccctgaactaaatccttctgtttgaattacctagtgtgattttgtttcctctctggatcctgactgctgcatgtcagtgctacacttgtgaaagtgcagtagcagaaacaacaccgttgacttaatgcaaatctgtttctgctaagtgtgagaaattattatttcca

SEQ ID NO: 1925 - DNA, 160 bp, Homo sapiens
acccttgaagtgatccactagtcgtaacccctccttccaccaatgattcaattggagaagtttagaggagtggaaagacttgtccccttcccccatcgcaagcttggtcacagagtgtattgccaacccatgtatccagacgctcagtctagggctcttg

SEQ ID NO: 1926 - DNA, 354 bp, Homo sapiens
tcaaagaagaaatctggaggctctgggttttgctcctgtcatgtctattctttcacttgtgcatttctcaactgttggtcaatgtgtgtttgcgttgcacaattttctttctttgttatttttactttttattttttctgagactgggtcttgctctgttgcccaggctagagtgcagtggcgccatcatggctcactgcagcctcagcctctagggttcaagtgaacctcccacctcggcctcctggatagcagagaccacaggcacatggtaccacacccagctaatttttgtgtattttttatagagatggggttttgccatgttgtccagactggtctcgagctcctggg

SEQ ID NO: 1927 - DNA, 205 bp, Homo sapiens
caaggggtctgacatcagactaatttatggaacaacaataaaactgcccctatttcctccccagaagccacattcagttacaaaaacttttactctaagctcagtcacaacaaaagttaggcatggaaaggcaatctctgaaaggtttttcatttgggatgtgatgaatgggtgaaggatgagcttttacagacacagggcccgg

SEQ ID NO: 1928 - DNA, 168 bp, Homo sapiens
gcagaggactgccaggaggcccatgcagctagagagactcaaaggaaaggagtggcaggatatgaggttatggaggtaatggagctctggatctcttaagtcctcgtaagatagtataagattgctgacttttcatatacacccaatataagaggtctggctggggtg

SEQ ID NO: 1929 - DNA, 183 bp, Homo sapiens
cagttacaagtacaagctctcaagttaaactgcctgtgttcttatcatggatctaccatgtactaattcaggaccctgggcaagttactcaagctttctgtacctttgttgcctcaggtataaaaaggagataaaaatagtacctacttcacaggactctttagaggaataaatcaactattg

SEQ ID NO: 1930 - DNA, 288 bp, Homo sapiens
gagagcaatgaacaggagaaggagggagagagccaaatgtctgagtaaacagatatcccttccaagtctcacacctcccttagtcccactcttgcttgtgtcagcaccttgttcttcactgaactgcaattcttcaattattctcttccatgattttgtctgatctaccatttctatggtttatggtaatagtattccctttatccctcccttttggtaacttccaatcctccttctatgtattcctttctctgctcattgacttataaatagttttcatacctctta

SEQ ID NO: 1931 - DNA, 264 bp, Homo sapiens
gaaaatagtaggtgaaatatgaatagtaggtgaataatggttcaattcacttttaagtgggagaagtaacgtgggagaagtccagatttcatggaacagatgacatggagttttaaacctgctgctggagacaccatcttttgaagctttgaaagccttgaggaacagctgtcggggtagaatttgagaactggggattggatttctagatggtagagcttccacagtaaacactaagaagcaaaacttgagatgaggcggagg

SEQ ID NO: 1932 - DNA, 132 bp, Homo sapiens
caagaatgttccagatgtttcctgtcctttcctccattcctccattaggtacctctcaaagcctaagttgatgataattctcttgggatgcaggtttagacatgtctatattaagagacatggcagggagtc

SEQ ID NO: 1933 - DNA, 269 bp, Homo sapiens
gaactcttactgcctgacattatattaaacattatttgcttatgtgtttattatttgtctcttgcactataatgtaagccccatgagaggagggacatttatagtgtcttttctactgaatccccagttgcctgaaactgcttgacacatagtatgctctttataacaacttgttgaatgaatgaatatgaatgaatgttgtgctaattattatttgaatgttgactcttccttttttttttgagataagatctcattctgtcactcag

SEQ ID NO: 1934 - DNA, 160 bp, Homo sapiens
ttcctcaccttcacttggattcttctctctcctgctgccatgtgaagaaggacgtgtttgctttcctttctgccataattgtaagttttctgaggcctccccagccacgctgaactgtgtgtcaactaaacctctttcctttctaaatacccagtctcag

SEQ ID NO: 1935 - DNA, 186 bp, Homo sapiens
actgattaggtttgcagccctgcagctatagaggcctctccaatactctgatctggaaaccacagggcaggaaaatccccaaagtcccatgaaatccaaagatccaaacgtggggtcgtttttatgccctcaggaaagttctgccaaaaaaagagatcttacacacagtgtaattgagagggcagt

SEQ ID NO: 1936 - DNA, 130 bp, Homo sapiens
ctggttctgtttgcctcagtttctgaagtatttctcctttttattatttgatgaatttttatgtttctctgcaatgatatcaactttatttaatcatgttttattatcatttcctgatggtcaaatgtgt

SEQ ID NO: 1937 - DNA, 132 bp, Homo sapiens
agttcagtagccctgctgttcttgctgatgtcacctcagcatgggctctccaggtatgtgcaaatagttatgcaagtgttgcatccacaggcttgtgagcagaggctgaaagggagccagggctcttggtac

SEQ ID NO: 1938 - DNA, 139 bp, Homo sapiens
cgtgtgctgaatgtcccataggaacatacaattactcaaagggtgtaatctctaaaacttcaccaaactccaagtgaagattcacttcattagtttttcttcctcctcatgaggccgtttaattctgtcaaaatgttta

SEQ ID NO: 1939 - DNA, 221 bp, Homo sapiens
gcattcaagaaaactctgccttgaagtttattaactgggaagactatgcacttattaaactgttggtgtcatagcccaaagctacttatagatgttattttaaaatgtcctcggagcctctggcatgctcttctagctttccttcatggaagcagatttccattcattaatgtaatgtttatcaaaatgcatggtttcccataaattacctcagaattttc

SEQ ID NO: 1940 - DNA, 208 bp, Homo sapiens
tggtgacattagtttgcagtgcaagtcatgtggtcatcacatacatgtgcaatatatgtgggagagcagaggctgggcaacctcagtaaaccttctccttcagagtgtgtaaaaacattgcacacaggtccattcacccagaagccttgatgggcagctatcctctcctgggttgggagtgtttcgctgattagctcctggttttgtt

SEQ ID NO: 1941 - DNA, 223 bp, Homo sapiens
tccagcaccttttccaggctgttccatcacaagtcatgggtaagtgctactaagtcaataaagcatctgccagcatgatgccgtaggaaagtttctttccatttgttctcctctcctaatggtcaatggttgcatgatggcattaatccactgcaccagtgagtgagatcgtctgagttgaggtattgcccaatgcatctgtgtaaagcctgaaggaagtggt

SEQ ID NO: 1942 - DNA, 222 bp, Homo sapiens
ttacttagcatagtgttctcaaggtttccgtgttgatcatgtatcagaactttactccttttcatagatgaatagtattccattgtatggatatgtcacattttatccattcatctgttgatgaatacttgggttgtttctatcttggctattgtgaataatgctgctatggacttggttgtacaaattatctgcttggacctcttctttcaagtcctttag

SEQ ID NO: 1943 - DNA, 156 bp, Homo sapiens
gtttgtttgctttttcctccaggtacattttagccatcgatattgacaaacactagcctggaaaggtatatttcaacatttcaaaatcattgtcatggagaacagaaagcggggggtggggggaatctattctatatattttcctcttgggcaatg

SEQ ID NO: 1944 - DNA, 162 bp, Homo sapiens
tgtcttttttctttctttcttttgtttttttttttctctgagacagagtctcactctgtcgctcaggctgcagtgcagtggtgtgtccttggctcactacaacctccgcttcccaggttcaagtgattctcatgcctcagctccctgagtagctaggactaa

SEQ ID NO: 1945 - DNA, 317 bp, Homo sapiens
caggaaaccttcttgttttcctttggggactaagcttaccatggaaagacagagttctttgccacacggtatacaccttacctagaaggcttgtcctgaaagagctgccctggactagggagataagatggcctaattctacagtgcagtcagcaggtccactggactctcacacaaagttatgccttccaacacatcctctatcagaaaaaaaaagatattctggtgggaaagaaatacattatttattgtgggtcccctcatagaccccaaattatgttaggaattacggcatatacatttcatccctaaggttt

SEQ ID NO: 1946 - DNA, 83 bp, Homo sapiens
ccagacaatgtctctaattgctctgagcgtacatctcatgtccgtcaggataaagttcagaaccttaacctggcatcaaggta

SEQ ID NO: 1947 - DNA, 176 bp, Homo sapiens
ttgtcttacacagtctaggggagcaatattatgataatccatggattaaatcaggagttacctgtaatttggcaatttatcaaaaataattaaagtaaaatgagaataccctttgtgaaattaagagctaccaggtggccaagacatgagaagcaatcaataaacagcaagctaat

SEQ ID NO: 1948 - DNA, 165 bp, Homo sapiens
agaaaaacttgccagttatttgggaggctttgtcttcttacatggaaaaaggtcactaatttctgaagctacctcctgtacagtagtatgagaatcctcagaggtaagaagacttgggccaataggtttgactttgttggttggattttcattattttccaaaga

SEQ ID NO: 1949 - DNA, 152 bp, Homo sapiens
taaattgttctcaggtattgtactgttgccatgagtttttccaggtaaaaatcaagtgttaataaaactgaggagaaagtgaggccttagtgacaccaggacccagagatcagttggacagagaggtgggtacagttcacaaggctccaggt

SEQ ID NO: 1950 - DNA, 178 bp, Homo sapiens
tcacagaggctcagaattacaaaatcctctggtagctttcatggcactctcactttaagactgcaagactgatggtttcttaataggaatgcctttccagcctgccttcaggggaaattacatacctctccaagtcctgtggcatttacagtttctactaccagcctggataatgatg

SEQ ID NO: 1951 - DNA, 169 bp, Homo sapiens
gagataagtgcagcattgtgtatatgaaaagggcaattcaacatgaagattttgggttgattcaagaaatgtaagtgatttaacattataacagtttaaaatatcatacaccacagtaacagattaaaaaaagaaaaatgtggctatcttaatctaaaaaggtaaaaca

SEQ ID NO: 1952 - DNA, 280 bp, Homo sapiens
caaacaaaacacgccaaatagtaaatctgtcagaagctgaagttaacttgggaggtaccaaagatactttctcagcacaggatacagggggtaccaggctggaggatgtttgggaagccgagcctcccatctccctgtctctgctggagacaggtttggagggtggtgatggagcctggagattgtggggatccccaagtgaaggctccccagtcccaaagtccaatcacctctccaggaaacagcagcatgaattctcttggacagctgcagaaacctc

SEQ ID NO: 1953 - DNA, 182 bp, Homo sapiens
cattggccacttctttgtggagacaagatatgccgccatgtctcccactctagggttccctggcaggaatggttgttggtcccctcacagtagcaagggatgccagtttcctctgcagtgcaggccaccatttaccacagtggtccccaccatgtggctgatactgatagcctctgcctttc

SEQ ID NO: 1954 - DNA, 145 bp, Homo sapiens
tatgttaaaaagacagaggagttaccccaaaaaagcttccaaaataaacaatagtattgggttataattcaaagaaaaaaataaatatttacgagtccatactgatataaatacatgactgaataagtaaatcgggtgtaagaga

SEQ ID NO: 1955 - DNA, 197 bp, Homo sapiens
gagtttttccgtggctacgataagttaatttaatgcatgtttaaataaatacttaaattaaaataacgttgattacgctctatggtatatactatcagacttcacccacctacttgtcttgtgtgttgaagcagacacaggttttctgaagaaaatgtggctctatccacctatattccttagcccactcagccctg

SEQ ID NO: 1956 - DNA, 181 bp, Homo sapiens
ttcctttagttagttctgtaggagtcctccctcttccatgtctcaccttagctttggatggaggttgtaccatccctttctcactgtgtcatataggatgtagctcattgaagaagtccctatacttggaaactacacttaaatgtaccttctataaaggatctaaagttccatataagac

SEQ ID NO: 1957 - DNA, 267 bp, Homo sapiens
tttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcatt

SEQ ID NO: 1958 - DNA, 216 bp, Homo sapiens
ctccagcctagacaacagagttagtgagattccgtctcaaaaaaaaaaaaaaaaaagacatttcttaatagttacactttaaataatgctatggctagaaattgaataaaaacctttggacttggttaataactatgacaagactagcacgaaatcctatttaaataaggcctcaatagagcaccatgacaaaacagaatcaacaaggttaattaa

SEQ ID NO: 1959 - DNA, 261 bp, Homo sapiens
gaggtcctgccacagagaatctatttactcaataaacgttcacaaaattgaattgtgggggacaccatggctccccggggcactattaaatcagatcccttctttcttaccaccaccaaaggataatgtcaagacatgggcattgattcggagaatccatttccagaattttacctattaaaattaaaaaaaatttaaatcaaaacaatagatatacatggtaacaagtcatgaaatacagaaacactcactgacagaaaa

SEQ ID NO: 1960 - DNA, 200 bp, Homo sapiens
aagattctgcctacagctggttttacgcagagaagtagcacacaaacccagtccatgatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgcc

SEQ ID NO: 1961 - DNA, 255 bp, Homo sapiens
tggcacatactaaccctggaaagccacggatgtggtgggcatgattcacagtgacatctggggctgactggcagagagctgggtgagacgggtagaagcaggtgctctcagggctacctctgcctttttcctgggaacatggagccctggaaggtggcttggggggcctttgaggggacaggggttacttatgggaaaggcagggacgtttcctgagctttggggtcatgatgtttgggggttgagattcatttt

SEQ ID NO: 1962 - DNA, 225 bp, Homo sapiens
atacagccctcttcctcctctctccctcctcctctgccatgagcctggcccgagcgagggcctgaatcttagcgtcttccacttaaatcccattataatcacgctcatgattgataacattccaccttttcaaagggctttaaaatctgtgtcaaccaaggatgacattattgtagtgcgggcgagatgtattcaaacaattacacgctcaaatcaaagtgggaa

SEQ ID NO: 1963 - DNA, 326 bp, Homo sapiens
gctgaggtgactcacagcctgttggataaatgacactaacatgtcagtccagccctttgccatctctcacagaagcccagtctgcggcagaattatctcaccaccctccagtccactatcggagtcctagagaatgttcaccagtgttttcctgtattttcaggcaaagtatttcaccttacagcaagtccagaggatggcagagattcacagtggcttctcttactgacctaacctgtcgctgagctctgtctataggaactgtgccagacagctcggttctcctgctcagtgatccctcctgctctcctgctgggtcctcgagt

SEQ ID NO: 1964 - DNA, 296 bp, Homo sapiens
ctctgctcttaagtaaaaaacccagagtcacctttctaccatgctaccttcagggcctgagcaagagtactgcgttgtagaagaggtggtgctttttagtatttaagtaattaaaccttccttgttgtattaaatccatatataataccttattccaacatatctcagatagtttctgtatctcagatagtttcagcaagagtttgtgtatggcaccgaatggacaagagctgtacatatatataaatgtcagaaagagaagaaaaatactaactgtaactttttggtttcctggt

SEQ ID NO: 1965 - DNA, 172 bp, Homo sapiens
tctgactccacaatgtaccaccctccaggtgtagtgcatcccccttccaccgtccctgcagccggcacggggtcccagccccttgagcttgatgggccatgggtaggcacttttattcacttctctgaagcatcagtttctgtttctgtgaaagtgagaatcacatcccaga

SEQ ID NO: 1966 - DNA, 350 bp, Homo sapiens
aatatatttaatatttaatacctctgaactgtacatgtaaagatggtaaattttaagttatgtgcattttaccacaatttttaaaagtttagtaaagaaaaaaatcaaagcataataaagattgtattcatactttggatcatacaaaggatcaagaagaacatatttaattgtagatccattaaatggggtctcccactgcttttcattaggcttcagttgtgaaaaagctttgtggatagcaaagtgctaaaactggaaggctttttaaactctgatcttactactatctttacaggattggtaattaaagttttaagaaggagatataggtaaaggatgctaatttt

SEQ ID NO: 1967 - DNA, 210 bp, Homo sapiens
tcccagggctcaacatcttcacaggcctgtctccacagaatcttcttctctggcttgctatgactggctatgactttggacagctgagcctgcttcctcacatgcaacacaggaataccctggaatgttcttgggggacagaatgaactaggccattgctgctaaaaactctagtagagatgctgatttcaagctcgcctataccaaact

SEQ ID NO: 1968 - DNA, 144 bp, Homo sapiens
gctgctcctgagtggctcacattccactttgattctcccatgtatttattctgttgtcatttagaatttttttactctgtacttaaaaagacagattggccaccatccctgtcctcacagacatttgcagccccttcagtgata

SEQ ID NO: 1969 - DNA, 219 bp, Homo sapiens
tttactaatctgatgcaaacaattggtgctaaatacatgttcattgaattaatggtcattataaaatatagctcttgctgccattctcatgaatagaatatactttcaaattgcaccctattaaatcttacatcaactctgctattctttttttttcccagctgaaatgtattaacatatgctgtaccatcacacaggagaagcctcagttcaaaagta

SEQ ID NO: 1970 - DNA, 148 bp, Homo sapiens
ttagaggatccttctgtgctccaagtcagccctgagtctccatgtctcttctctttcttcccaaacacccactgagcactgtggggtattgaccgcagcccttaccttccagggactttgatgatgcataaaatgaggtcatccctgg

SEQ ID NO: 1971 - DNA, 248 bp, Homo sapiens
tttaaatcatttaaatatattcaacaatttaaagaaaatcatgtctgaataactatagaaaccatgagaataatgtctcaccaaataaaaaatccaataaagaaacagaacttataaagttaaagagaaattctggagtaggaaagcacaacaacttaaataacatttcactagagaggatcaagaacacacttgggcagcacacttggtaagcataagaaaaatcagtaaaattgaagataggttaa

SEQ ID NO: 1972 - DNA, 425 bp, Homo sapiens
tcttccttttctgtatcttgtttacctttttttttttttttgtctactacctatcagggaactactaaccccctgcacacaccgtctctcactcttaggacaatgaaccattcaagttaatgactgcttttcccatctgacagaaaagcaaactaaaccctagaagtccagtcatataattaaagcagcacggagagcaggctctgagatagggtctggaacacagcgatgtgtggcttcaaggccatcatattctctttccagcctctacacactgtatagtgcccacccatcataaagaacaccctcagagctctgccattgtatgagtcattcctttgggggcctgcactcttacttgcctgtgttatttggggtgggtgggtgggtcacaaggtggaaagtttcagcagagtgaagaatat

What is claimed is:

1. A method of analyzing a sample from a patient for cell-free DNA associated with prostate cancer to calculate a numeric index of tumor-associated copy number variability, the method comprising:
   (a) isolating cell-free DNA from a blood, serum, or plasma sample from the patient;
   (b) sequencing cell-free DNA molecules and:
      (i) for a plurality of circulating cell-free DNA molecules, assigning each cell-free DNA sequences to one or more genomic regions, and selecting those cell-free DNA sequences that are unique sequences for their respective genomic region; and
      (ii) determining a normalized copy number of each selected cell-free DNA molecule;
   (c) comparing the normalized copy number of each selected cell-free DNA molecule to a reference distribution obtained from known cancer free individuals;
   (d) summing all normalized copy number values of regions having a normalized copy number value exceeding the 95% percentile of the reference distribution;
   (e) summing all negative normalized copy number values of regions that have a normalized copy number value less than the 5% percentile of the reference distribution; and
   (f) obtaining the numeric index of tumor-associated copy number variability using the sums obtained in (d) and (e), thereby analyzing the sample from the patient for cell-free DNA associated with prostate cancer.

2. The method of claim 1, wherein the numeric index value of (f) is compared to the distribution of the numeric index value obtained from cancer-free control subjects, where a numeric index value exceeding the $95^{th}$ percentile of the distribution of the numeric index value of the control population is indicative of cancer.

3. the method of claim 1, wherein cell-free DNA sequences selected in (b) comprises one or more sequences from Table 2, Table 3, Table 4, or Table 5.

* * * * *